(12) United States Patent
Bernett et al.

(10) Patent No.: US 10,550,185 B2
(45) Date of Patent: Feb. 4, 2020

(54) BISPECIFIC HETERODIMERIC FUSION PROTEINS CONTAINING IL-15-IL-15Rα FC-FUSION PROTEINS AND PD-1 ANTIBODY FRAGMENTS

(71) Applicant: Xencor, Inc., Monrovia, CA (US)

(72) Inventors: Matthew Bernett, Monrovia, CA (US); Rumana Rashid, Azusa, CA (US); John Desjarlais, Pasadena, CA (US); Rajat Varma, Monrovia, CA (US); Christine Bonzon, Los Angeles, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 15/785,393

(22) Filed: Oct. 16, 2017

(65) Prior Publication Data
US 2018/0118828 A1    May 3, 2018

Related U.S. Application Data

(60) Provisional application No. 62/408,655, filed on Oct. 14, 2016, provisional application No. 62/443,465, filed on Jan. 6, 2017, provisional application No. 62/477,926, filed on Mar. 28, 2017, provisional application No. 62/416,087, filed on Nov. 1, 2016.

(51) Int. Cl.
| | | |
|---|---|---|
| *C07K 16/28* | (2006.01) | |
| *C07K 14/54* | (2006.01) | |
| *C12N 15/63* | (2006.01) | |
| *A61P 35/00* | (2006.01) | |
| *C07K 14/715* | (2006.01) | |
| *A61K 35/00* | (2006.01) | |
| *A61K 38/00* | (2006.01) | |
| *A61K 39/00* | (2006.01) | |

(52) U.S. Cl.
CPC .......... *C07K 16/2818* (2013.01); *A61P 35/00* (2018.01); *C07K 14/5443* (2013.01); *C07K 14/7155* (2013.01); *C12N 15/63* (2013.01); *A61K 38/00* (2013.01); *A61K 2039/505* (2013.01); *C07K 2317/24* (2013.01); *C07K 2317/31* (2013.01); *C07K 2317/35* (2013.01); *C07K 2317/524* (2013.01); *C07K 2317/53* (2013.01); *C07K 2317/55* (2013.01); *C07K 2317/565* (2013.01); *C07K 2317/622* (2013.01); *C07K 2317/92* (2013.01); *C07K 2317/94* (2013.01); *C07K 2319/30* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |

(Continued)

FOREIGN PATENT DOCUMENTS

| | | |
|---|---|---|
| EP | 0425235 B1 | 9/1996 |
| EP | 0927254 | 6/2005 |

(Continued)

OTHER PUBLICATIONS

Chappel et al., "Identification of a Secondary Fcγ RI Binding Site within a Genetically Engineered Human IgG Actibody," J. Biol. Chem., 268(33):25124-25131 (Nov. 1993).

(Continued)

*Primary Examiner* — Bridget E Bunner
(74) *Attorney, Agent, or Firm* — Jennifer K. Ng; Robin M. Silva; Morgan, Lewis & Bockius, LLP

(57) ABSTRACT

The present invention is directed to novel bispecific heterodimeric Fc fusion proteins comprising an IL-15/IL-15Rα Fc-fusion protein and a PD-1 antibody fragment-Fc fusion protein.

13 Claims, 142 Drawing Sheets

Specification includes a Sequence Listing.

(56) References Cited

U.S. PATENT DOCUMENTS

| | | |
|---|---|---|
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,737,056 B1 | 5/2004 | Presta |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,276,585 B2 | 10/2007 | Lazar et al. |
| 7,303,749 B1 | 12/2007 | Chari |
| 7,355,008 B2 | 4/2008 | Stavenhagen et al. |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,632,497 B2 | 12/2009 | Stavenhagen |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 7,834,152 B2 | 11/2010 | Strom et al. |
| 7,858,081 B2 | 12/2010 | Bernard et al. |
| 7,960,512 B2 | 6/2011 | Stavenhagen et al. |
| 8,003,774 B2 | 8/2011 | Stavenhagen et al. |
| 8,063,187 B2 | 11/2011 | Chu et al. |
| 8,114,967 B2 | 2/2012 | Bhatt et al. |
| 8,124,084 B2 | 2/2012 | LeFrancois et al. |
| 8,192,737 B2 | 6/2012 | Stavenhagen et al. |
| 8,216,574 B2 | 7/2012 | Stavenhagen |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,629,245 B2 | 1/2014 | Georgiou et al. |
| 8,637,641 B2 | 1/2014 | Dahiyat et al. |
| 8,679,493 B2 | 3/2014 | Georgiou et al. |
| 8,742,074 B2 | 6/2014 | Behrens et al. |
| 8,871,912 B2 | 10/2014 | Davis et al. |
| 8,940,288 B2 | 1/2015 | LeFrancois et al. |
| 8,940,289 B2 | 1/2015 | Wong et al. |
| 8,946,387 B2 | 2/2015 | Koenig et al. |
| 8,951,517 B2 | 2/2015 | Stavenhagen et al. |
| 9,028,815 B2 | 5/2015 | Stavenhagen et al. |
| 9,150,663 B2 | 10/2015 | Labrijn et al. |
| 9,308,258 B2 | 4/2016 | Kannan et al. |
| RE45,992 E | 5/2016 | Behrens et al. |
| 9,365,630 B2 | 6/2016 | LeFrancois et al. |
| 9,371,368 B2 | 6/2016 | LeFrancois et al. |
| 9,464,127 B2 | 10/2016 | Wong et al. |
| 9,493,533 B2 | 11/2016 | Bernard et al. |
| 9,505,848 B2 | 11/2016 | Davis et al. |
| 9,527,926 B2 | 12/2016 | Ho et al. |
| 9,562,109 B2 | 2/2017 | Von Kreudenstein et al. |
| 9,683,052 B2 | 6/2017 | Blein et al. |
| 9,683,053 B2 | 6/2017 | Blein et al. |
| 9,763,705 B2 | 9/2017 | Faulhaber |
| 9,822,181 B2 | 11/2017 | Bonvini et al. |
| 9,856,327 B2 | 1/2018 | Bernett et al. |
| 9,931,377 B2 | 4/2018 | Pavlakis et al. |
| 9,932,387 B2 | 4/2018 | LeFrancois et al. |
| 9,969,790 B2 | 5/2018 | LeFrancois et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2006/0263857 A1 | 11/2006 | LeFrancois et al. |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |

(56) References Cited

U.S. PATENT DOCUMENTS

| | | |
|---|---|---|
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0238791 A1 | 9/2009 | Jacques et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0267934 A1 | 10/2010 | Van de Winkel et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0177595 A1 | 7/2012 | Wong et al. |
| 2012/0251531 A1 | 10/2012 | Baehner et al. |
| 2012/0251541 A1 | 10/2012 | Baurin et al. |
| 2013/0039913 A1 | 2/2013 | Labrijn et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0131319 A1 | 5/2013 | Igawa et al. |
| 2013/0142793 A1 | 6/2013 | Ledbetter et al. |
| 2013/0171095 A1 | 7/2013 | Bernett et al. |
| 2013/0178605 A1 | 7/2013 | Blein et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0072581 A1 | 3/2014 | Dixit et al. |
| 2014/0086916 A1 | 3/2014 | Zha |
| 2014/0187753 A1 | 7/2014 | Blein et al. |
| 2014/0199294 A1 | 7/2014 | Mimoto et al. |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0335089 A1 | 11/2014 | Igawa et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2015/0351275 A1 | 12/2015 | Imbimbo et al. |
| 2016/0060360 A1 | 3/2016 | Moore et al. |
| 2016/0068584 A1 | 3/2016 | Bechard et al. |
| 2016/0068588 A1 | 3/2016 | Bernett et al. |
| 2016/0157951 A1 | 6/2016 | Schoenig et al. |
| 2016/0175459 A1 | 6/2016 | Gey et al. |
| 2016/0176969 A1 | 6/2016 | Bernett et al. |
| 2016/0184399 A1 | 6/2016 | Bechard et al. |
| 2016/0215063 A1 | 7/2016 | Bernett et al. |
| 2016/0229924 A1 | 8/2016 | Bernett et al. |
| 2016/0318986 A1 | 11/2016 | Morisseau et al. |
| 2016/0333067 A1 | 11/2016 | LeFrancois et al. |
| 2016/0347818 A1 | 12/2016 | LeFrancois et al. |
| 2016/0367635 A1 | 12/2016 | Wong et al. |
| 2017/0020963 A1 | 1/2017 | Qu et al. |
| 2017/0056874 A1 | 3/2017 | Bechard et al. |
| 2017/0088597 A1 | 3/2017 | Wong et al. |
| 2017/0145078 A1 | 5/2017 | Davis et al. |
| 2017/0151310 A1 | 6/2017 | Felber et al. |
| 2017/0233497 A1 | 8/2017 | Labrijn et al. |
| 2018/0094077 A1 | 4/2018 | Blein et al. |
| 2018/0118805 A1 | 5/2018 | Bernett et al. |
| 2018/0118828 A1 | 5/2018 | Bernett et al. |
| 2018/0194860 A1 | 7/2018 | Von Kreudenstein et al. |
| 2018/0200366 A1 | 7/2018 | Wong et al. |
| 2018/0298079 A1 | 10/2018 | LeFrancois et al. |
| 2018/0312560 A1 | 11/2018 | Morisseau et al. |

FOREIGN PATENT DOCUMENTS

| | | |
|---|---|---|
| EP | 1752471 | 2/2007 |
| EP | 1829895 | 5/2007 |
| EP | 3263581 | 1/2008 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 1718670 | 7/2011 |
| EP | 1934353 | 10/2011 |
| EP | 2155788 | 2/2014 |
| EP | 2388266 | 4/2014 |
| EP | 3093295 | 11/2016 |
| EP | 2769984 | 8/2017 |
| EP | 3235830 | 10/2017 |
| EP | 3030575 | 7/2018 |
| EP | 2724728 | 10/2018 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO1997041232 | 11/1997 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |

(56) References Cited

FOREIGN PATENT DOCUMENTS

| | | |
|---|---|---|
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005085282 | 9/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007001677 | 1/2007 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008143794 | 11/2008 |
| WO | WO2008145142 | 12/2008 |
| WO | WO2008150494 | 12/2008 |
| WO | WO2009000006 | 12/2008 |
| WO | WO2009002562 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010151792 | 12/2010 |
| WO | WO2010151808 | 12/2010 |
| WO | WO2011005621 | 1/2011 |
| WO | WO2011020047 A1 | 2/2011 |
| WO | WO2011028952 | 3/2011 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011133886 | 10/2011 |
| WO | WO2011143545 | 11/2011 |
| WO | WO2012016227 | 2/2012 |
| WO | WO2012018687 | 2/2012 |
| WO | WO2012032080 | 3/2012 |
| WO | WO2012040323 A2 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2012175222 | 12/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014170032 | 10/2014 |
| WO | WO2014209804 | 12/2014 |
| WO | WO2015018528 | 2/2015 |
| WO | WO2015018529 | 2/2015 |
| WO | WO2015026892 | 2/2015 |
| WO | WO2015063339 | 5/2015 |
| WO | WO2015103072 | 7/2015 |
| WO | WO2015103928 | 7/2015 |
| WO | WO2015131994 | 9/2015 |
| WO | WO2015143079 | 9/2015 |
| WO | WO2015149077 | 10/2015 |
| WO | WO2015184207 | 12/2015 |
| WO | WO2016014984 | 1/2016 |
| WO | WO2016086186 | 6/2016 |
| WO | WO2016086189 | 6/2016 |
| WO | WO2016086196 | 6/2016 |
| WO | WO2016095642 | 6/2016 |
| WO | WO2016105450 | 6/2016 |
| WO | WO2016141387 | 9/2016 |
| WO | WO2016182751 | 11/2016 |
| WO | WO2018071918 | 4/2018 |
| WO | WO2018071919 | 4/2018 |

OTHER PUBLICATIONS

Chappel et al., "Identification of the Fcγ receptor class I binding site in human IgG through the use of recombinant IgG1/IgG2 hybrid and point-mutated antibodies," PNAS, USA, 88:9036-9040 (Oct. 1991).

Miranda-Carus et al., IL-15 and the initiation of cell contact-dependent synovial fibroblast-T lymphocyte cross-talk in rheumatoid arthritis: effect of methotrexate., 2004 J. Immunol. 13:1463-1476.

Koka et al, Cutting edge: murine dendritic cells require IL-15R alpha to prime NK cells., 2004 J. Immunol. 173:3594-3598.

Matsumoto et al., On-column refolding and characterization of soluble human interleukin-15 receptor alpha-chain produced in *Escherichia coli.*, Protein Purification and Expression, 2003 64-71.

Schluns et al., Distinct cell types control lymphoid subset development by means of IL-15 and IL-15 receptor alpha expression., PNAS 101(5):5616-5621, 2004.

(56) References Cited

OTHER PUBLICATIONS

Wei et al., The Sushi domain of soluble IL-15 receptor alpha is essential for binding IL-15 and inhibiting inflammatory and allogenic responses in vitro and in vivo., J. Immunol. 167:277-282, 2001.
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the Internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of in vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., Preparation, properties, and applications of carbohydrate conjugates of proteins and lipids, 1981, CRC Crit. Rev. Biochem., pp. 259-306.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optomizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chichili et al., Co-targeting of PD-1 and CTLA-4 Inhibitory Pathways with Bispecific DART@ and TRIDENT™ Molecules., Apr. 4, 2017, retrieved from the internet: http://files.shareholder.com/downloads/AMDA-278VRP/0x0x935572/8CC86417-40BA-41C0-

(56) References Cited

OTHER PUBLICATIONS

935D-EF1B7DB0B5BB/AACR_2017_-_Co-targeting_PD-1_and_CTLA-4_Inhibitory_Pathways_with_DART_and_TRIDENT_Molecules.pdf.

Chothia et al., Canonical structures for the hypervariable regions of immunoglobulins, 1987, J. Mol. Biol. 196:901-917.

Chothia, et al., Structural Determinants in the Sequences of Immunoglobulin Variable Domain, J. Mol. Biol., 1998, vol. 278, pp. 457-479.

Chu et al., Immunotherapy with Long-Lived Anti-CD123 × Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.

Conrad, et al., TCR and CD3 Antibody Cross-Reactivity in 44 Species, Cytometry Part A, 2007, vol. 71A, pp. 925-933.

Conrath, et al., Antigen Binding and Solubility Effects upon the Veneering of a Camel VHH in Framework-2 to Mimic a VH, J. Mol. Biol. , 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.

Cuesta, et al., Multivalent antibodies: when design surpasses evolution, Trends in Biotechnology, 2010, vol. 28, No. 7, pp. 355-362, doi:10.1016/j.tibtech.2010.03.007.

D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

De Groot et al., De-Immunization of Therapeutic Proteins by T-Cell Epitope Modification, 2005, Dev. In Biologicals, 2005, 122:171-194.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Del Nagro et al., A critical role for complement C3d and the B cell coreceptor (CD19/CD21) complex in the initiation of inflammatory arthritis., J Immunol. Oct. 15, 2005;175(8):5379-89.

Demarest et al., Antibody therapeutics, antibody engineering, and the merits of protein stability, Current Opinin in Drug Discovery & Development, 2008 11(5): 675-587, Sep. 11, 2008.

Deyev, et al., Multivalency: the hallmark of antibodies used for optimization of tumor targeting by design, BioEssays, 2008, vol. 30, pp. 904-918.

DiGiammarino et al., Ligand association rates to the inner-variable-domain of a dual-variable-domain immunoglobulin are significantly impacted by linker design, mAbs3:5, 1-8; Sep-Oct; 3(5):487-94, Landes Bioscience, Sep. 1, 2011.

DiGiandomenico et al., A multifunctional bispecific antibody protects against Pseudomonas aeruginosa., Sci Transl Med. Nov. 12, 2014;6(262):262ra155.doi. 10.1126/scitranslmed.3009655.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Doronina , Development of potent monoclonal antibody auristatin conjugates for cancer therapy, 2003, Nat Biotechnol 21(7):778-784.

Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.

Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.

Dubowchik et al., Receptor-mediated and enzyme-dependent targeting of cytotoxic anticancer drugs, 1999, Pharm. Therapeutics 83:67-123.

Ducry et al., Antibody-drug conjugates: linking cytotoxic payloads to monoclonal antibodies, 2010, Bioconjugate Chem. 21:5-13.

Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

Duke, et al., Measurement of apoptosis and other forms of cell death, 2004, Curr protocols immunol. 3.17.1-3.17.16.

DukSin et al., Relationship of the structure and biological activity of the natural homologues of tunicamycin, 1982, J. Biol. Chem. 257:3105.

Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.

Edge et al., Deglycosylation of glycoproteins by trifluoromethanesulfonic acid, 1981, Anal. Biochem. 118:131.

Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.

Feldmann et al., Retargeting of T Cells to Prostate Stem Cell Antigen Expressing Tumor Cells: Comparison of Different Antibody Formats, Dec. 28, 2010.

Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.

Fischer, Nicolas et al., "Bispecifc antibodies: molecules that enable novel therapeutic strategies", 2007, vol. 74, pp. 3-14.

Foreman, et al., ErbB3 Inhibitory Surrobodies Inhibit Tumor Cell Proliferation in Vitro and in Vivo, Mol Cancer Ther, 2012, vol. 11(7) , pp. 1411-1420.

Foreman, et al., PEGS poster, "ErbB3 Inhibitory Surrobodies Inhibit Tumor Cell Proliferation in Vitro and in Vivo," 2012.

Fraker et al., Crystal structure of peptide cyclo-(D-VAL-L-PRO-L-VAL-D-PRO)$_3$, 1978, Biochem. Biophys. Res. Commun. 80(4):849-57.

Francois, et al., Construction of a Bispecific Antibody Reacting with the α-and β-Chains of the Human IL-2 Receptor, The Journal of Immunology, May 15, 1993, vol. 150, No. 10, pp. 4610-4619.

F-star Modular Antibodies Fact Sheet, Apr. 2008, "Modular Antibody Technology" (w/ reference to Ruker WO 2006/072620 A1).

(56) References Cited

OTHER PUBLICATIONS

F-star Modular Antibodies Press Release, Mar. 28, 2008, "Antibody Engineering Company F-Star Buys Back Royalty Obligations. TVM Capital Joins Investor Syndicate."

Fudenberg, et al., Serologic Demonstration of Dual Specificity of Rabbit Bivalent Hybrid Antibody, The Journal of Experimental Medicine, 1964, vol. 119(1), pp. 151-166.

Ganesan, et al., FcγRIIb on Liver Sinusoidal Endothelium Clears Small Immune Complexes, The Journal of Immunology, Nov. 15, 2012, vol. 189 No. 10, pp. 4981-4988.

GenBank AAA38124.1, immunoglobulin heavy-chain VJ region [*Mus musculus*] Protein/NCBI, 1993.

GenBank AAA39180.1, immunoglobulin light-chain VJ region [*Mus musculus*] Protein/NCBI, 1993.

Ghendler et al., One of the CD3ε Subunits within a T Cell Receptor Complex Lies in Close Proximity to the Cβ FG Loop, J. Exp. Med., 1998, vol. 187, No. 9. pp. 1529-1536.

Ghetie et al., Multiple roles for the major histocompatibility complex Class I-related receptor FcRn, 2000, Annu Rev Immunol 18:739-766.

Gilliland, et al., Universal bispecific antibody for targeting tumor cells for destruction by cytotoxic T cells, Proc. Natl. Acad. Sci. USA, 1988, vol. 85, pp. 7719-7723.

Gorman et al., Reshaping a therapeutic CD4 antibody, Proc. Natl. Acad. Sci. USA 88:4181-4185, 1991.

Grodzki & Bernstein, "Antibody Purification: Ion-Exchange Chromatography.", Methods Mol Biol 2010 ;588:27-32.

Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.

Haagen, et al., The Efficacy of CD3 × CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.

Hakimuddin et al., A chemical method for the deglycosylation of proteins, 1987, Arch. Biochem. Biophys. 259:52.

Hamel, et al., The Role of the $V_L$- and $V_H$-Segments in the Preferential Reassociation of Immunoglobulin Subunits, Molecular Immunology, 1986, vol. 23, No. 5, pp. 503-510.

HAwkins et al, Selection of phage antibodies by binding affinity mimicking affinity maturation, 1992, J. Mol. Biol. 226:889-896.

Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.

He et al., Humanization and pharmacokinetics of a monoclonal antibody with specificity for both E- and P-selectin, 1998, J. Immunol. 160:1029-1035.

Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.

Hennecke et al., "Non-repetitive single-chain Fv linkers selected by selectively infective phage (SIP) technology.", Protein Eng. May 1998;11(5):405-10.

Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.

Hexham, et al., Influence of relative binding affinity on efficacy in a panel of anti-CD3 scFv immunotoxins, Molecular Immunology, 2001, vol. 38, pp. 397-408.

Hinman et al., Preparation and characterization of monoclonal antibody conjugates of the calicheamicins: a novel and potent family of antitumor antibodies, 1993 Cancer Res. 53:3336-3342.

Hoffmann, et al., Serial killing of tumor cells by cytotoxic T cells redirected with a CD19-/CD3-bispecific single-chain antibody construct, Int. J. Cancer, 2005, vol. 115, pp. 98-104.

Holliger et al., "Diabodies": Small Bivalent and bispecific antibody fragments, 1993, Proc. Natl. Acad. Sci. U.S.A. 90:6444-6448.

Holliger et al., Engineering bispecific antibodies, 1993, Current Opinion Biotechnol. 4:446-449.

Houtenbos, et al., The novel bispecific diabody αCD40/αCD28 strengthens leukaemic dendritic cell-induced T-cell reactivity, British Journal of Haematology, 2008, vol. 142, pp. 273-283.

Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.

Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.

Igawa et al., Reduced elimination of IgG antibodies by engineering the variable region, 2010, PEDS. 23(5): 385-392.

Igawa, $V_{H/VL}$ interface engineering to promote selective expression and inhibit conformational isomerization of thrombopoietin receptor agonist single-chain diabody, Protein Engineering, Design & Selection, 2010, vol. 23, No. 8, pp. 667-677.

Ishigaki et al., Impact of Plasma Oxidized Low-Density Lipoprotein Removal on Atherosclerosis., Circulation 118: 75-83, 2008.

Jackson et al., In vitro antibody maturation, 1995, J. Immunol. 154(7):3310-9.

Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.

Jefferis et al., Interaction sites on human IgG-Fc for FcγyR: current models, 2002, Immunol Lett 82:57-65.

Jespers, et al., Crystal Structure of HEL4, a Soluble, Refoldable Human $V_H$ Single Domain with a Germ-line Scaffold, J. Mol. Biol., 2004, vol. 337, pp. 893-903.

Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.

Jin et al. The Design and Engineering of IgG-Like Bispecific Antibodies., Chapter 9, Bispecific Antibodies, pp. 151-169, 2008.

Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.

Johnson et al., Anti-tumor activity of CC49-doxorubicin immunoconguates, 1995, Anticancer Res. 15:1387-93.

Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.

Jones et al., Replacing the complementarity-determining regions in a human antibody with those from a mouse, 1986, Nature 321:522-525.

Jordan et al., Structural understanding of stabilization patterns in engineered bispecific Ig-like antibody molecules, Proteins 2009; 77:832-841, Jun. 19, 2009.

Jung, et al., Design of interchain disulfide bonds in the framework region of the Fv fragment of the monoclonal antibody B3, Proteins, 1994, vol. 19(1), pp. 35-47.

Jung, et al., Target Cell-restricted Triggering of the CD95 (APO-1/Fas) Death Receptor with Bispecific Antibody Fragments, Cancer Research, 2001, vol. 61, pp. 1846-1848.

Jungbluth et al., A monoclonal antibody recognizing human cancers with amplification/overexpression of the human epidermal growth factor receptor, 2003, Proc Natl Acad Sci U S A. 100(2):639-44.

Kabat et al., 1991, Sequences of proteins of immunological interest, Department of Health and Human Services, Bethesda, vol. 1, 5$^{th}$ Ed.

Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.

Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

(56) References Cited

OTHER PUBLICATIONS

Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 × Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3 × CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell—engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information, 2013.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No, 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyene antibiotic calicheamicins $o^i_1$ effectively suppress growth and dissemination of liver metastases in a syngeneic model of murine neuroblastoma, 1998, Cancer Res. 58:2928.
Löffler, et al., A recombinant bispecific single-chain antibody, CD19 × CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

(56) References Cited

OTHER PUBLICATIONS

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.lmmunol, 1996, vol. 43, pp. 134-139.

Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting 1L-17A and 1L-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al, Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011, 135-149.

Metz, et al., Bispecific antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.

Miller et al., Stability engineering of scFvs for the development of bispecific and multivalent antibodies, PEDS, 2010, vol. 23, No. 7, pp. 549-557 & Supplementary Data.

Miller, biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency", 2013.

Mimoto et al., Engineered antibody Fc variant with selectively enhanced FcγRIIb binding over both FcγγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

Modjtahedi et al, Phase I trial and tumour localization of the anti-EGFR monoclonal antibody ICR62 in head and neck or lung cancer, 1996, Br J Cancer, 73(2):228-35.

Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3):129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44 , pp. 1935-1943.

Moore et al., Tuning T Cell Affinity Improves Efficacy and Safety of Anti-CD38 × Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):O9.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No. 5, pp. 447-454.

(56) References Cited

OTHER PUBLICATIONS

Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432. CCR-13/0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Rothlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3—Surface Expression Is Required for CD4-p56ick-mediated Up-regulation of T Cell Antigen Receptor-CD3 Signaling in T Cells, Apr. 16, 1992.

(56) References Cited

OTHER PUBLICATIONS

Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.

Schaefer, et al., Immunoglobulin domain crossover as a generic approach for the production of bispecific IgG antibodies, PNAS, 2011, vol. 108, No. 27, pp. 11187-11192.

Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.

Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.

Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.

Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.

Schroder et al., The Peptides, vol. pp. 76-136, 1965, Academic Press.

Senter et al, Proceedings of the American Association for Cancer Research, 2004, vol. 45, Abstract No. 623.

Senter, Potent antibody drug conjugates for cancer therapy, 2009, Current Opin. Chem. Biol. 13:235.

Sforzini et al., Targeting of saporin to Hodgkin's lymphoma cells by anti-CD30 and anti-CD25 bispecific antibodies., Br J Haematol. Sep. 1998;102(4):1061-8.

Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human α/β T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Shields et al., Lack of fucose on human IgG1 N-linked oligosaccharide improves binding to human FcγRIII and antibody-dependent cellular toxicity, 2002, J Biol Chem 277:26733-26740.

Shier et al., Identification of functional and structural amino-acid residues by parsimonious mutagenesis, 1995, Gene 169:147-155.

Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.

Skehan et al., Identification of functional and structural amino-acid residues by parsimonious mutagenesis, 1990, J. Natl. Cancer Inst. 82(13):1107-12.

Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.

Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Stamova, Unexpected recombinations in single chain bispecific anti-CD3-anti-CD33 antibodies can be avoided by a novel linker module, Oct. 29, 2011.

Stanfield, et al., Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Szymkowski et al., Creating the next generation of protein therapeutics through rational drug design, Current opinion in drug discovery & development, Sep. 1, 2005, p. 590, XP055354917, England.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-19258.

Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Thorne, et al., CD36 is a receptor for oxidized high density lipoprotein: implications for the development of atherosclerosis., FEBS Lett. Mar. 20, 2007;581(6):1227-32. Epub Feb. 28, 2007.

Thorpe et al., New coupling agents for the synthesis of immunotoxins containing a hindered disulfide bond with improved stability in Vivo, 1987, Cancer Res. 47:5924-5931.

(56) References Cited

OTHER PUBLICATIONS

Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell—Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498, 2011.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble $\alpha\beta$ T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fc$\gamma$ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55, 1988.
Weatherill, et al., Towards a universal disulphide stabilised single chain Fv format: importance of interchain disulphide bond location and vL—vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6, No. 8, pp. 989-995.
Wigginton et al., An immunoglobulin E-reactive chimeric human immunoglobulin G1 anti-idiotype inhibits basophil degranulation through cross-linking of FceRI with Fc$\gamma$RIIb., Clinical & Experimental Allergy, 38: 313-319, 2007.
Wong, et al., the Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molecular construction and optimization of anti-human IL-11$\alpha$/$\beta$ dual variable domain immunoglobulin (DVD-Ig™) molecules, [mAbs 1:4, 339-347; Jul./Aug. 2009]; Landes Bioscience, Apr. 10, 2009.
Wu et al, Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296, pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein volume in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

(56) References Cited

OTHER PUBLICATIONS

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Ziebig et al., Effect of the oxLDL Binding Protein Fc-CD68 on Plaque Extension and Vulnerability in Atherosclerosis., Circulation Research 108: 695-703, 2011.

Zuo, et al., An efficient route to the production of an IgG-like bispecific antibody, Protein Engineering, 2000, vol. 13, No. 5, pp. 361-367.

Chu et al., Immunotherapy with Long-Lived Anti-CD123 × Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Intery Aging. 2009;4:197-205. Epub May 14, 2009.

Han et al., IL-15:IL-15 receptor alpha superagonist complex: high-level co-expression in recombinant mammalian cells, purification and characterization., Cytokine. Dec. 2011;56(3):804-10.

Stone et al., Design and characterization of a protein superagonist of IL-15 fused with IL-15Rα and a high-affinity T cell receptor., Biotechnol Prog. Nov.-Dec. 2012;28(6):1588-97.

Kermer et al., An antibody fusion protein for cancer immunotherapy mimicking IL-15 trans-presentation at the tumor site., Mol Cancer Ther. Jun. 2012;11(6):1279-88.

Kermer et al., Combining Antibody-Directed Presentation of IL-15 and 4-1BBL in a Trifunctional Fusion Protein for Cancer Immunotherapy, Mol Cancer Ther. Jan. 2014;13(1):112-21.

C. Bergamaschi et al, "Intracellular Interaction of Interleukin-15 with Its Receptor during Production Leads to Mutual Stabilization and Increased Bioactivity", Journal of Biological Chemistry, vol. 283, No. 7, pp. 4189-4199.

Genbank accession No. NM_172174, 2010.

Genbank accession No. NP_002180, 2018.

S. Dubois et al, "IL-15RαRecycles and Presents IL-15 in Trans to Neighbouring Cells", Immunity, vol. 17, 537-547, 2002.

Y Tagaya et al, "Generation of secretable and non-secretable interleukin-15 isoforms through alternate usage of signal peptides", Proc. Natl. Acad. Sci. USA, vol. 44, 14444-14449, 1997.

Genbank accession No. AF031167.1, 1992.

D Anderson et al, "Functional Characterization of the Human IL-15 Receptor α Chain and Close Linkage of IL15RA and IL2RA genes", J. Biol. Chem., vol. 270, No. 50, 29862-29869, 1995.

Assignment abstract of title for U.S. Appl. No. 12/666,052; 2011.

Mortier E et al, "Natural, Proteolytic Release of a Soluble Form of Human IL-15 Receptor α-Chain That Behaves as a Specific, High Affinity IL-15 Antagonist", J. Immunol 2004; 173: 1681-1688.

Figure 2A

Human IL-15 precursor sequence (SEQ ID NO: 16)

>sp|P40933
MRISKPHLRSISIQCYLCLLLNSHFLTEAGIHVFILGCFSAGLPKTEANWVNVISDLKKIEDLIQSMHIDATLYT
ESDVHPSCKVTAMKCFLLELQVISLESGDASIHDTVENLIILANNSLSSNGNVTESGCKECEELEEKNIKEFLQS
FVHIVQMFINTS

Human IL-15 mature form sequence (SEQ ID NO: 17)

>sp|P40933|49-162
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Human IL-15Rα sequence (SEQ ID NO: 18)

>sp|Q13261
MAPRRARGCRTLGLPALLLLLLLRPPATRGITCPPPMSVEHADIWVKSYSLYSRERYICNSGFKRKAGTSSLTEC
VLNKATNVAHWTTPSLKCIRDPALVHQRPAPPSTVTTAGVTPQPESLSPSGKEPAASSPSSNNTAATTAAIVPGS
QLMPSKSPSTGTTEISSHESSHGTPSQTTAKNWELTASASHQPPGVYPQGHSDTTVAISTSTVLLCGLSAVSLLA
CYLKSRQTPPLASVEMEAMEALPVTWGTSSRDEDLENCSHHL

Human IL-15Rα, extracellular domain (SEQ ID NO: 19)

>sp|Q13261|31-205
ITCPPPMSVEHADIWVKSYSLYSRERYICNSGFKRKAGTSSLTECVLNKATNVAHWTTPSLKCIRDPALVHQRPA
PPSTVTTAGVTPQPESLSPSGKEPAASSPSSNNTAATTAAIVPGSQLMPSKSPSTGTTEISSHESSHGTPSQTTA
KNWELTASASHQPPGVYPQGHSDTT

Human IL-15Rα, sushi domain (SEQ ID NO: 20)

>sp|Q13261|31-95
ITCPPPMSVEHADIWVKSYSLYSRERYICNSGFKRKAGTSSLTECVLNKATNVAHWTTPSLKCIR

Human IL-15Rß sequence (SEQ ID NO: 21)

>sp|P14784
MAAPALSWRLPLLILLLPLATSWASAAVNGTSQFTCFYNSRANISCVWSQDGALQDTSCQVHAWPDRRRWNQTCE
LLPVSQASWACNLILGAPDSQKLTTVDIVTLRVLCREGVRWRVMAIQDFKPFENLRLMAPISLQVVHVETHRCNI
SWEISQASHYFERHLEFEARTLSPGHTWEEAPLLTLKQKQEWICLETLTPDTQYEFQVRVKPLQGEFTTWSPWSQ
PLAFRTKPAALGKDTIPWLGHLLVGLSGAFGFIILVYLLINCRNTGPWLKKVLKCNTPDPSKFFSQLSSEHGGDV
QKWLSSPFPSSSFSPGGLAPEISPLEVLERDKVTQLLLQQDKVPEPASLSSNHSLTSCFTNQGYFFFHLPDALEI
EACQVYFTYDPYSEEDPDEGVAGAPTGSSPQPLQPLSGEDDAYCTFPSRDDLLLFSPSLLGGPSPPSTAPGGSGA
GEERMPPSLQERVPRDWDPQPLGPPTPGVPDLVDFQPPPELVLREAGEEVPDAGPREGVSFPWSRPPGQGEFRAL
NARLPLNTDAYLSLQELQGQDPTHLV

Human IL-15Rß, extracellular domain (SEQ ID NO: 22)

>sp|P14784|27-240
AVNGTSQFTCFYNSRANISCVWSQDGALQDTSCQVHAWPDRRRWNQTCELLPVSQASWACNLILGAPDSQKLTTV
DIVTLRVLCREGVRWRVMAIQDFKPFENLRLMAPISLQVVHVETHRCNISWEISQASHYFERHLEFEARTLSPGH
TWEEAPLLTLKQKQEWICLETLTPDTQYEFQVRVKPLQGEFTTWSPWSQPLAFRTKPAALGKDT

Figure 2B

Human common gamma chain sequence (SEQ ID NO: 23)

```
>sp|P31785
MLKPSLPFTSLLFLQLPLLGVGLNTTILTPNGNEDTTADFFLTTMPTDSLSVSTLPLPEVQCFVFNVEYMNCTWN
SSSEPQPTNLTLHYWYKNSDNDKVQKCSHYLFSEEITSGCQLQKKEIHLYQTFVVQLQDPREPRRQATQMLKLQN
LVIPWAPENLTLHKLSESQLELNWNNRFLNHCLEHLVQYRTDWDHSWTEQSVDYRHKFSLPSVDGQKRYTFRVRS
RFNPLCGSAQHWSEWSHPIHWGSNTSKENPFLFALEAVVISVGSMGLIISLLCVYFWLERTMPRIPTLKNLEDLV
TEYHGNFSAWSGVSKGLAESLQPDYSERLCLVSEIPPKGGALGEGPGASPCNQHSPYWAPPCYTLKPET
```

Human common gamma chain, extracellular domain (SEQ ID NO: 24)

```
>sp|P31785|23-262
LNTTILTPNGNEDTTADFFLTTMPTDSLSVSTLPLPEVQCFVFNVEYMNCTWNSSSEPQPTNLTLHYWYKNSDND
KVQKCSHYLFSEEITSGCQLQKKEIHLYQTFVVQLQDPREPRRQATQMLKLQNLVIPWAPENLTLHKLSESQLEL
NWNNRFLNHCLEHLVQYRTDWDHSWTEQSVDYRHKFSLPSVDGQKRYTFRVRSRFNPLCGSAQHWSEWSHPIHWG
SNTSKENPFLFALEA
```

Figure 3A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 3C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 3D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 3E

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| K247Q/R355Q/Q419E/K447_ | P217R/P228R/N276K |
| K247Q/R355Q/Q419E/K447_ | N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 4

| Variant constant region | Substitutions |
|---|---|
| pI_ISO(-) | I199T/N203D/K274Q/R355Q/N384S/K392N/V397M/Q419E/K447_ |
| pI_ISO(-)-Fc only | K274Q/R355Q/N384S/K392N/V397M/Q419E/K447_ |
| pI_(-)_isosteric A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 5

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 6A

| IL-15-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6B

| scIL-15/Rα-Fc monomer (-) | empty-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6C

| empty-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6D

| IL-15Rα(sushi)-Fc Chain 1 | IL-15Rα(sushi)-Fc Chain 2 |
|---|---|
| C220S | C220S |
| FcKO E233P/L234V/L235A/G236_/S267K | FcKO E233P/L234V/L235A/G236_/S267K |
| ±M428L/N434S | ±M428L/N434S |

Figure 6E

| Fc-IL-15Rα(sushi) (-) | IL-15Rα(sushi)-Fc monomer (+) |
|---|---|
| C220S | C220S |
| Heterodimer pI variants L368D/K370S | Heterodimer pI variants S364K/E357Q |
|  | Isosteric pI substitutions P217R/P228R/N276K |
| FcKO | FcKO |
| E233P/L234V/L235A/G236_/S267K | E233P/L234V/L235A/G236_/S267K |
| ±M428L/N434S | ±M428L/N434S |

Figure 7A

| scIL-15/Rα-Fc monomer (-) | scFv-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7B

| scFv-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7C

| scIL-15/Rα-Fc monomer (-) | Heavy Chain (+) |
|---|---|
| C220S | |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7D

| Heavy Chain (-) | IL-15Rα(sushi)-Fc monomer (+) |
|---|---|
| | C220S |
| Heterodimer pI variants L368D/K370S | Heterodimer pI variants S364K/E357Q |
| Isosteric pI substitutions N208D/Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7E

| Heavy Chain-IL-15Rα(sushi) (-) | Heavy Chain (+) |
|---|---|
| Heterodimer pI variants L368D/K370S | Heterodimer pI variants S364K/E357Q |
| Isosteric pI substitutions N208D/Q295E/N384D/Q418E/N421D | Isosteric pI subsitutions Q196K/I199T/P217R/P228R/N276K |
| FcKO E233P/L234V/L235A/G236_/S267K | FcKO E233P/L234V/L235A/G236_/S267K |
| ±M428L/N434S | ±M428L/N434S |

Figure 7F

| Heavy Chain (-) | Heavy Chain-IL-15Rα(sushi) (+) |
|---|---|
| Heterodimer pI variants L368D/K370S | Heterodimer pI variants S364K/E357Q |
| Isosteric pI substitutions N208D/Q295E/N384D/Q418E/N421D | Isosteric pI subsitutions Q196K/I199T/P217R/P228R/N276K |
| FcKO E233P/L234V/L235A/G236_/S267K | FcKO E233P/L234V/L235A/G236_/S267K |
| ±M428L/N434S | ±M428L/N434S |

Figure 8

| Name | Sequence | SEQ ID NO: |
|---|---|---|
| (GGGGS)$_1$ or GGGGS | GGGGS | 25 |
| (GGGGS)$_2$ | GGGGSGGGGS | 26 |
| (GGGGS)$_3$ | GGGGSGGGGSGGGGS | 27 |
| (GGGGS)$_4$ | GGGGSGGGGSGGGGSGGGGS | 28 |
| (GGGGS)$_5$ | GGGGSGGGGSGGGGSGGGGSGGGGS | 29 |
| (GGGGS)$_6$ | GGGGSGGGGSGGGGSGGGGSGGGGSGGGGS | 30 |
| (GGGGS)$_7$ | GGGGSGGGGSGGGGSGGGGSGGGGSGGGGSGGGGS | 31 |
| 30AA-linker | DPALVHQRPAPPGGGGSGGGGSGGGGSGGG | 32 |
| (GKPGS)$_1$ or GKPGS | GKPGS | 33 |
| (GKPGS)$_5$ | GKPGSGKPGSGKPGSGKPGSGKPGS | 34 |
| (GKPGS)$_6$ | GKPGSGKPGSGKPGSGKPGSGKPGSGKPGS | 35 |
| (GGGES)$_1$ or GGGES | GGGES | 36 |

Figure 9A

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 37 |
| Whitlow linker | GSTSGSGKPGSGEGSTKG | 18 | +1 | 38 |
| 6paxA_1 (+A) | IRPRAIGGSKPRVA | 14 | +4 | 39 |
| +B | GKGGSGKGGSGKGGS | 15 | +3 | 40 |
| +C | GGKGSGGKGSGGKGS | 15 | +3 | 41 |
| +D | GGGKSGGGKSGGGKS | 15 | +3 | 42 |
| +E | GKGKSGKGKSGKGKS | 15 | +6 | 43 |
| +F | GGGKSGGKGSGKGGS | 15 | +3 | 44 |
| +G | GKPGSGKPGSGKPGS | 15 | +3 | 45 |
| +H | GKPGSGKPGSGKPGSGKPGS | 20 | +4 | 46 |
| +I | GKGKSGKGKSGKGKSGKGKS | 20 | +8 | 47 |

Figure 9B

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 48 |
| 3hsc_2 (-A) | STAGDTHLGGEDFD | 14 | -4 | 49 |
| -B | GEGGSGEGGSGEGGS | 15 | -3 | 50 |
| -C | GGEGSGGEGSGGEGS | 15 | -3 | 51 |
| -D | GGGESGGGESGGGES | 15 | -3 | 52 |
| -E | GEGESGEGESGEGES | 15 | -6 | 53 |
| -F | GGGESGGEGSGEGGS | 15 | -3 | 54 |
| -G | GEGESGEGESGEGESGEGES | 20 | -8 | 55 |

Figure 9C

Additional scFv Linkers

| | |
|---|---|
| GGGGSGGGGSGGGGS | SEQ ID NO:56 |
| GGGGSGGGGSGGGGSGGGGS | SEQ ID NO:57 |
| GSTSGSGKPGSGEGSTKG | SEQ ID NO:58 |
| PRGASKSGSASQTGSAPGS | SEQ ID NO:59 |
| GTAAAGAGAAGGAAAGAAG | SEQ ID NO:60 |
| GTSGSSGSGSGGSGSGGGG | SEQ ID NO:61 |
| GKPGSGKPGSGKPGSGKPGS | SEQ ID NO:62 |

Figure 10A

IL-15/Rα-Fc Backbone 1

>IL-15/Rα-Fc monomer 1 (SEQ ID NO: 63)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>IL-15/Rα-Fc monomer 2 (SEQ ID NO: 64)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 2

>IL-15/Rα-Fc monomer 1 (SEQ ID NO: 65)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>IL-15/Rα-Fc monomer 2 (SEQ ID NO: 66)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 3

>IL-15/Rα-Fc monomer 1 (SEQ ID NO: 67)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>IL-15/Rα-Fc monomer 2 (SEQ ID NO: 68)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CEVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 4

>IL-15/Rα-Fc monomer 1 (SEQ ID NO: 69)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSKGSFFLYSKLTVDKSRWQQGNVFSCSVMHEALHNHYTQKSL
SLSPGK

>IL-15/Rα-Fc monomer 2 (SEQ ID NO: 70)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTENEVSLT
CLVKGFYPSDIAVEWESDGQPENNYKTTPPVLDSDGSFFLYSKLEVDKSRWEQGDVFSCSVMHEALHNHYTQKSL
SLSPGK

Figure 10B

IL-15/Rα-Fc Backbone 5

\>IL-15/Rα-Fc monomer 1 (SEQ ID NO: 71)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSRDQLTKNQVKLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO: 72)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSRDELTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 6

\>IL-15/Rα-Fc monomer 1 (SEQ ID NO: 73)
EPKSSDKTHTCPPCPAPPVAGPSVFLFPPKPKDTLMISRTPEVTCVVVDVKHEDPEVKFNWYVDGVEVHNAKTKP
REEQYASTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO: 74)
EPKSSDKTHTCPPCPAPPVAGPSVFLFPPKPKDTLMISRTPEVTCVVVDVKHEDPEVKFNWYVDGVEVHNAKTKP
REEEYASTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 7

\>IL-15/Rα-Fc monomer 1 (SEQ ID NO: 75)
EPKSSDKTHTCPPCPAPPVAGPSVFLFPPKPKDTLMISRTPEVTCVVVDVKHEDPEVKFNWYVDGVEVHNAKTKP
REEQYSSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO: 76)
EPKSSDKTHTCPPCPAPPVAGPSVFLFPPKPKDTLMISRTPEVTCVVVDVKHEDPEVKFNWYVDGVEVHNAKTKP
REEEYSSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 8

\>IL-15/Rα-Fc monomer 1 (SEQ ID NO: 77)
ESKYGPPCPPCPAPEFLGGPSVFLFPPKPKDTLMISRTPEVTCVVVDVSQEDPEVQFNWYVDGVEVHNAKTKPRE
EQFNSTYRVVSVLTVLHQDWLNGKEYKCKVSNKGLPSSIEKTISKAKGQPREPQVYTLPPSQEQMTKNQVKLTCL
VKGFYPSDIAVEWESNGQPENNYKTTPPVLDSDGSFFLYSRLTVDKSRWQEGNVFSCSVMHEALHNHYTQKSLSL
SLGK \>IL-15/Rα-Fc monomer 2 (SEQ ID NO: 78)
ESKYGPPCPPCPAPEFLGGPSVFLFPPKPKDTLMISRTPEVTCVVVDVSQEDPEVQFNWYVDGVEVHNAKTKPRE
EEFNSTYRVVSVLTVLHQDWLNGKEYKCKVSNKGLPSSIEKTISKAKGQPREPQVYTLPPSQEEMTKNQVSLTCD
VSGFYPSDIAVEWESDGQPENNYKTTPPVLDSDGSFFLYSRLTVDKSRWEEGDVFSCSVMHEALHNHYTQKSLSL
SLGK

Figure 10C

IL-15/Rα-Fc Backbone 9

\>IL-15/Rα-Fc monomer 1 (SEQ ID NO: 79)
ERKCCVECPPCPAPPVAGPSVFLFPPKPKDTLMISRTPEVTCVVVDVSHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK \>IL-15/Rα-Fc monomer 2 (SEQ ID NO: 80)
ERKCCVECPPCPAPPVAGPSVFLFPPKPKDTLMISRTPEVTCVVVDVSHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 10

\>IL-15/Rα-Fc monomer 1 (SEQ ID NO: 81)
ERKCCVECPPCPAPPVAGPSVFLFPPKPKDTLMISRTPEVTCVVVDVKHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK \>IL-15/Rα-Fc monomer 2 (SEQ ID NO: 82)
ERKCCVECPPCPAPPVAGPSVFLFPPKPKDTLMISRTPEVTCVVVDVKHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 11

\>IL-15/Rα-Fc monomer 1 (SEQ ID NO: 83)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK \>IL-15/Rα-Fc monomer 2 (SEQ ID NO: 84)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVLHEALHSHYTQKSL
SLSPGK

IL-15/Rα-Fc Backbone 12

\>IL-15/Rα-Fc monomer 1 (SEQ ID NO: 85)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO: 86)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK

Figure 10D

IL-15/Rα-Fc Backbone 13

>IL-15/Rα-Fc monomer 1 (SEQ ID NO: 87)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

>IL-15/Rα-Fc monomer 2 (SEQ ID NO: 88)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 11

IL-15/Rα x anti-PD-1 Backbone 1

>Chain 1 (SEQ ID NO: 89)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK

>Chain 2 (SEQ ID NO: 90)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

IL-15/Rα x anti-PD-1 Backbone 2

>Chain 1 (SEQ ID NO: 91)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK

>Chain 2 (SEQ ID NO: 92)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK

IL-15/Rα x anti-PD-1 Backbone 3

>Chain 1 (SEQ ID NO: 93)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK

>Chain 2 (SEQ ID NO: 94)
ASTKGPSVFPLAPSSKSTSGGTAALGCLVKDYFPEPVTVSWNSGALTSGVHTFPAVLQSSGLYSLSSVVTVPSSSLGTKTYTCNVNHKPS
NTKVDKKVERKSCDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK

Figure 12

Constant Light Chain – Kappa (SEQ ID NO: 95)
RTVAAPSVFIFPPSDEQLKSGTASVVCLLNNFYPREAKVQWKVDNALQSGNSQESVTEQDSKDSTYSLSSTLTLSKADYEKHKVYACEVT
HQGLSSPVTKSFNRGEC

Constant Light Chain – Lambda (SEQ ID NO: 96)
GQPKAAPSVTLFPPSSEELQANKATLVCLISDFYPGAVTVAWKADSSPVKAGVETTTPSKQSNNKYAASSYLSLT
PEQWKSHRSYSCQVTHEGSTVEKTVAPTECS

Figure 13A

XENP016432 Nivolumab_H0L0_IgG1_PVA_/S267K

| What | sequence | SEQ ID NO: |
|---|---|---|
| Variable heavy (vh) domain | QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS | 97 |
| vhCDR1 | NSGMH | 98 |
| vhCDR2 | VIWYDGSKRYYADSVKG | 99 |
| vhCDR3 | NDDY | 100 |
| Full length HC | QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 101 |
| Variable light (vl) domain | EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK | 102 |
| vlCDR1 | RASQSVSSYLA | 103 |
| vlCDR2 | DASNRAT | 104 |
| vlCDR3 | QQSSNWPRT | 105 |
| Full length light chain | EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 106 |

Figure 13B

XENP024120 LOPD180[PD-1]_H1L1_IgG1_PVA_/S267K

| What | Sequence | SEQ ID NO: |
|---|---|---|
| Variable heavy (vh) domain | QVQLQESGPGLVKPSQTLSLTCTVSGGSISSSGAYYWSWIRQHPGKGLEWIGYIYYNGNTYYNPSLRSRVTISVDTSKNQFSLKLSSVTAA DTAVYYCVRASDYVWGGYHYFDAFDLWGRGTLVTVSS | 107 |
| vhCDR1 | SGAYYWS | 108 |
| vhCDR2 | YIYYNGNTYYNPSLRS | 109 |
| vhCDR3 | ASDYVWGGYHYFDAFDL | 110 |
| Full length HC | QVQLQESGPGLVKPSQTLSLTCTVSGGSISSSGAYYWSWIRQHPGKGLEWIGYIYYNGNTYYNPSLRSRVTISVDTSKNQFSLKLSSVTAA DTAVYYCVRASDYVWGGYHYFDAFDLWGRGTLVTVSS/ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKKVEPKSCDKTHTCPPCPAPPVAGPSVFLFPPKPKDTLMISRTPEV TCVVVDVKHEDPEVKFNWYVDGVEVHNAKTKPREEQYNSTYRVVSVLTVLHQDWLNGKEYKCKVSNKALPAPIEKTISKAKGQPREP QVYTLPPSREEMTKNQVSLTCLVKGFYPSDIAVEWESNGQPENNYKTTPPVLDSDGSFFLYSKLTVDKSRWQQGNVFSCSVMHEALH NHYTQKSLSLSPGK | 111 |
| Variable light (vl) domain | QSVLTQPPSASGTPGQRVTISCSGSNSNIGSNSVNWYQQLPGTAPKLLIYGNNQRPSGVPDRFSGSKSGTSASLAISGLQSEDEADYYC AAWDDSLNGPVFGGGTKVTVL | 112 |
| vlCDR1 | SGSNSNIGSNSVN | 113 |
| vlCDR2 | GNNQRPS | 114 |
| vlCDR3 | AAWDDSLNGPV | 115 |
| Full length light chain | QSVLTQPPSASGTPGQRVTISCSGSNSNIGSNSVNWYQQLPGTAPKLLIYGNNQRPSGVPDRFSGSKSGTSASLAISGLQSEDEADYYC AAWDDSLNGPVFGGGTKVTVL/GQPKAAPSVTLFPPSSEELQANKATLVCLISDFYPGAVTVAWKADSSPVKAGVETTTPSKQSNNKY AASSYLSLTPEQWKSHRSYSCQVTHEGSTVEKTVAPTECS | 116 |

Figure 13C

XENP024121 mAb7(1.2)[PD-1]_H1L1_IgG1_PVA_/S267K

| What | sequence | SEQ ID NO: |
|---|---|---|
| Variable heavy (vh) domain | QVQLQQPGTELMKPGASVKLSCKASGYTFTTYWMHWVKQRPGQGLEWIGEIDPSDSYVNYNQNFKGKATLTVDKSSSTAYIQLSSLT SEDSAVYFCARSPDYYGTSLAWFDYWGQGTLVTVST | 117 |
| vhCDR1 | TYWMH | 118 |
| vhCDR2 | EIDPSDSYVNYNQNFKG | 119 |
| vhCDR3 | SPDYYGTSLAWFDY | 120 |
| Full length HC | QVQLQQPGTELMKPGASVKLSCKASGYTFTTYWMHWVKQRPGQGLEWIGEIDPSDSYVNYNQNFKGKATLTVDKSSSTAYIQLSSLT SEDSAVYFCARSPDYYGTSLAWFDYWGQGTLVTVSTASTKGPSVFPLAPSSKSTSGGTAALGCLVKDYFPEPVTVSWNSGALTSGVHT FPAVLQSSGLYSLSSVVTVPSSSLGTQTYICNVNHKPSDTKVDKKVEPKSCDKTHTCPPCPAPPVAGPSVFLFPPKPKDTLMISRTPEVTC VVVDVKHEDPEVKFNWYVDGVEVHNAKTKPREEEYNSTYRVVSVLTVLHQDWLNGKEYKCKVSNKALPAPIEKTISKAKGQPREPQVY TLPPSREEMTKNQVSLTCDVSGFYPSDIAVEWESDGQPENNYKTTPPVLDSDGSFFLYSKLTVDKSRWEQGDVFSCSVMHEALHNHYT QKSLSLSPGK | 121 |
| Variable light (vl) domain | EIVLTQSPATLSLSPGERATLSCRASESVDNYGMSFMNWFQQKPGQPPKLLIHAASNQGSGVPSRFSGSGSGTDFTLTISSLEPEDFAVY FCQQSKEVPYTFGGGTKVEIK | 122 |
| vlCDR1 | RASESVDNYGMSFMN | 123 |
| vlCDR2 | AASNQGS | 124 |
| vlCDR3 | QQSKEVPYT | 125 |
| Full length light chain | EIVLTQSPATLSLSPGERATLSCRASESVDNYGMSFMNWFQQKPGQPPKLLIHAASNQGSGVPSRFSGSGSGTDFTLTISSLEPEDFAVY FCQQSKEVPYTFGGGTKVEIK/RTVAAPSVFIFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC | 126 |

Figure 13D

XENP019686 1G6_H1.279_L1.194_IgG1_PVA_/S267K

| What | sequence | SEQ ID NO: |
|---|---|---|
| Variable heavy (vh) domain | EVQLVESGGGLVKPGGSLRLSCVASGFTFSNYWMNWVRQAPGKGLEWVAEIRLYSNNYATHYAESVKGRFTISRDDSKSTLYLQMNN LKTEDTGVYYCTRYYGNYGGYFDVWGRGTLVTVSS | 127 |
| vhCDR1 | NYWMN | 128 |
| vhCDR2 | EIRLYSNNYATHYAESVKG | 129 |
| vhCDR3 | YYGNYGGYFDV | 130 |
| Full length HC | EVQLVESGGGLVKPGGSLRLSCVASGFTFSNYWMNWVRQAPGKGLEWVAEIRLYSNNYATHYAESVKGRFTISRDDSKSTLYLQMNN LKTEDTGVYYCTRYYGNYGGYFDVWGRGTLVTVSS/ASTKGPSVFPLAPSSKSTSGGTAAALGCLVKDYFPEPVTVSWNSGALTSGVHTF PAVLQSSGLYSLSSVVTVPSSSLGTQTYICNVNHKPSNTKVDKKVEPKSCDKTHTCPPCPAPPVAGPSVFLFPPKPKDTLMISRTPEVTCV VVDVKHEDPEVKFNWYVDGVEVHNAKTKPREEQYNSTYRVVSVLTVLHQDWLNGKEYKCKVSNKALPAPIEKTISKAKGQPREPQVY TLPPSREEMTKNQVSLTCLVKGFYPSDIAVEWESNGQPENNYKTTPPVLDSDGSFFLYSKLTVDKSRWQQGNVFSCSVMHEALHNHY TQKSLSLSPGK | 131 |
| Variable light (vl) domain | EIVLTQSPATLSASPGERVTLTCRASQSVGNDVAWYQQKPGQAPRLLINYASHRYTGVPDRFTGSGYGTEFTLTISSVQSEDFGVYYCQ QDFSSPRTFGGGTKVEIK | 132 |
| vlCDR1 | RASQSVGNDVA | 133 |
| vlCDR2 | YASHRYT | 134 |
| vlCDR3 | QQDFSSPRT | 135 |
| Full length light chain | EIVLTQSPATLSASPGERVTLTCRASQSVGNDVAWYQQKPGQAPRLLINYASHRYTGVPDRFTGSGYGTEFTLTISSVQSEDFGVYYCQ QDFSSPRTFGGGTKVEIK/RTVAAPSVFIFPPSDEQLKSGTASVVCLLNNFYPREAKVQWKVDNALQSGNSQESVTEQDSKDSTYSLSST LTLSKADYEKHKVYACEVTHQGLSSPVTKSFNRGEC | 136 |

Figure 13E

XENP020156 2E9_H1L1_IgG1_PVA_/S267K

| What | sequence | SEQ ID NO: |
|---|---|---|
| Variable heavy (vh) domain | QVQLVQSGAEVKKPGASVKVSCKASGYAFTNYWLGWVRQAPGQGLEWMGNFYPGSSNTYYNEKFQGRVTMTADKSISTAYMELSR LRSDDTAVYFCARHYGTNYRYFDYWGAGTLVTVSS | 137 |
| vhCDR1 | NYWLG | 138 |
| vhCDR2 | NFYPGSSNTYYNEKFQG | 139 |
| vhCDR3 | HYGTNYRYFDY | 140 |
| Full length HC | QVQLVQSGAEVKKPGASVKVSCKASGYAFTNYWLGWVRQAPGQGLEWMGNFYPGSSNTYYNEKFQGRVTMTADKSISTAYMELSR LRSDDTAVYFCARHYGTNYRYFDYWGAGTLVTVSS/ASTKGPSVFPLAPSSKSTSGGTAALGCLVKDYFPEPVTVSWNSGALTSGVHTF PAVLQSSGLYSLSSVVTVPSSSLGTQTYICNVNHKPSNTKVDKKVEPKSCDKTHTCPPCPAPPVAGPSVFLFPPKPKDTLMISRTPEVTCV VVDVKHEDPEVKFNWYVDGVEVHNAKTKPREEQYNSTYRVVSVLTVLHQDWLNGKEYKCKVSNKALPAPIEKTISKAKGQPREPQVY TLPPSREEMTKNQVSLTCLVKGFYPSDIAVEWESNGQPENNYKTTPPVLDSDGSFFLYSKLTVDKSRWQQGNVFSCSVMHEALHNHY TQKSLSLSPGK | 141 |
| Variable light (vl) domain | DIVLTQSPGTLSLSPGERATLSCRASQSVSNDVAWYQQKPGQSPRLLIYYASNRYTGVPDRFTGSGYGTDFTLTISRLEPEDFAVYFCQQ DYSSPYTFGGGTKVEIK | 142 |
| vlCDR1 | RASQSVSNDVA | 143 |
| vlCDR2 | YASNRYT | 144 |
| vlCDR3 | QQDYSSPYT | 145 |
| Full length light chain | DIVLTQSPGTLSLSPGERATLSCRASQSVSNDVAWYQQKPGQSPRLLIYYASNRYTGVPDRFTGSGYGTDFTLTISRLEPEDFAVYFCQQ DYSSPYTFGGGTKVEIK/RTVAAPSVFIFPPSDEQLKSGTASVVCLLNNFYPREAKVQWKVDNALQSGNSQESVTEQDSKDSTYSLSSTL TLSKADYEKHKVYACEVTHQGLSSPVTKSFNRGEC | 146 |

Figure 14A XENP19690 1G6_H1.279_L1.194 anti-PD-1 Fv sequences

| What | sequence | SEQ ID NO: |
|---|---|---|
| Vh domain | EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS | 147 |
| vhCDR1 | NYWMN | 148 |
| vhCDR2 | EIRLYSNNYATHYAESVKG | 149 |
| vhCDR3 | YYGNYGGYFDV | 150 |
| scFv linker | GKPGSGKPGSGKPGSGKPGS | 46 |
| Vl domain | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK | 151 |
| vlCDR1 | RASQSVGNDVA | 152 |
| vlCDR2 | YASHRYT | 153 |
| vlCDR3 | QQDFSSPRT | 154 |
| scFv | EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS/GKPGSGKPGSGKPGSGKPGS/EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/ | 155 |

Figure 14B 1G6_H1.280_L1.224 anti-PD-1 Fv sequences

| What | sequence | SEQ ID NO: |
|---|---|---|
| Variable heavy (vh) domain | EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS | 156 |
| vhCDR1 | NYWMN | 157 |
| vhCDR2 | EIRLYSNNYATHYAESVKG | 158 |
| vhCDR3 | YYGNYGGYFDV | 159 |
| scFv linker | GKPGSGKPGSGKPGSGKPGS | 46 |
| Variable light (vl) domain | EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK | 160 |
| vlCDR1 | RASQSVGNDVA | 161 |
| vlCDR2 | YASHRYT | 162 |
| vlCDR3 | QQDWSSPRT | 163 |
| scFv | EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS/GKPGSGKPGSGKPGSGKPGS/EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK | 164 |

Figure 14C XENP19692 1G6_L1.194_H1.279 anti-PD-1 Fv sequences

| What | sequence | SEQ ID NO: |
|---|---|---|
| Variable heavy (vh) domain | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK | 165 |
| vhCDR1 | RASQSVGNDVA | 166 |
| vhCDR2 | YASHRYT | 167 |
| vhCDR3 | QQDFSSPRT | 168 |
| scFv linker | GKPGSGKPGSGKPGSGKPGS | 46 |
| Variable light (vl) domain | EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS | 169 |
| vlCDR1 | NYWMN | 170 |
| vlCDR2 | EIRLYSNNYATHYAESVKG | 171 |
| vlCDR3 | YYGNYGGYFDV | 172 |
| scFv | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/GKPGSGKPGSGKPGSGKPGS/EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS | 173 |

Figure 14D XENP19669 1G6_L1.210_H1.288 anti-PD-1 Fv sequences

| What | sequence | SEQ ID NO: |
|---|---|---|
| Variable heavy (vh) domain | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK | 174 |
| vhCDR1 | RASQSVGNDVA | 175 |
| vhCDR2 | YASHRYT | 176 |
| vhCDR3 | QQDFSSPRT | 177 |
| scFv linker | GKPGSGKPGSGKPGSGKPGS | 46 |
| Variable light (vl) domain | EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS | 178 |
| vlCDR1 | NYWMN | 179 |
| vlCDR2 | EIRLYSNNYATHYAESVKG | 180 |
| vlCDR3 | YYGNYGGYFDV | 181 |
| scFv | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK/GKPGSGKPGSGKPGSGKPGS/EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS | 182 |

Figure 14E XENP20162 2E9_H1L1 anti-PD-1 Fv sequences

| What | sequence | SEQ ID NO: |
|---|---|---|
| Variable heavy (vh) domain | QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS | 183 |
| vhCDR1 | NYWLG | 184 |
| vhCDR2 | NFYPGSSNTYYNEKFQG | 185 |
| vhCDR3 | HYGTNYRYFDV | 186 |
| scFv linker | GKPGSGKPGSGKPGSGKPGS | 46 |
| Variable light (vl) domain | DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK | 187 |
| vlCDR1 | RASQSVSNDVA | 188 |
| vlCDR2 | YASNRYT | 189 |
| vlCDR3 | QQDYSSPYT | 190 |
| scFv | QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS/GKPGSGKPGSGKPGSGKPGS/DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK | 191 |

Figure 14F 1C11H3_L3 anti-PD-1 Fv sequences

| What | sequence | SEQ ID NO: |
|---|---|---|
| Variable heavy (vh) domain | QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS | 192 |
| vhCDR1 | HYGMN | 193 |
| vhCDR2 | WINTYTGEPTYADGFTG | 194 |
| vhCDR3 | DYYGSSPY | 195 |
| scFv linker | GKPGSGKPGSGKPGSGKPGS | 46 |
| Variable light (vl) domain | DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK | 196 |
| vlCDR1 | KSSQSIVHSNGNTYLE | 197 |
| vlCDR2 | KVSNRFS | 198 |
| vlCDR3 | FQGSHVPNT | 199 |
| scFv | QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS/GKPGSGKPGSGKPGSGKPGS/DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK | 200 |

Figure 15

XENP021575 1C11[PD-1]_H0L0_IgG1_PVA_/S267K Heavy Chain (SEQ ID NOS 201-205)
QIQLVQSGPELKKPGETVKISCRASGYTFTHYGMNWVKQAPGKGLKWMGWINTYTGEPTYADDFKGRFAFSLETSASTAYLQINNLKNEDTAT
YFCARDYYGSSPYWGQGTTLTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

XENP021575 1C11[PD-1]_H0L0_IgG1_PVA_/S267K Light Chain (SEQ ID NOS 206-210)
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYC
FQGSHVPNTFGGGTKLEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 19

>XENP022856 1C11_H3L3_IgG1_PVA_/S267K/M428L/N434S Heavy Chain (SEQ ID NOS 211-215)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVLHEALHSHYTQKSLSLSPGK

>XENP022856 1C11_H3L3_IgG1_PVA_/S267K/M428L/N434S Light Chain (SEQ ID NOS 216-220)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 20

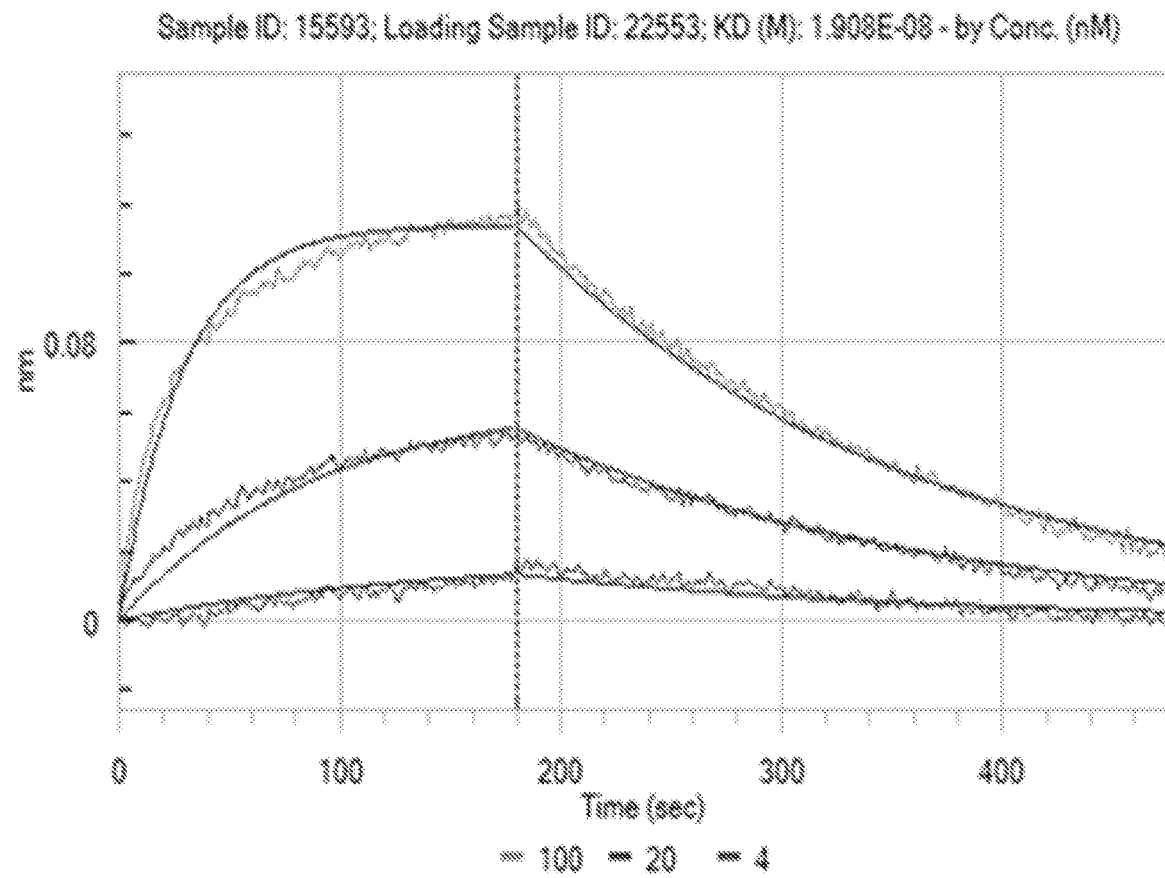

IL-15/Rα-heteroFc
Example: XENP20818 scIL-15/Rα-Fc
Example: XENP21478 ncIL-15/Rα-Fc
Example: XENP21479

Bivalent ncIL-15/Rα-Fc
Example: XENP21978

Bivalent scIL-15/Rα-Fc

Fc-ncIL-15/Rα
Example: XENP22637

Fc-scIL-15/Rα

Figure 22

>XENP20818 – human IL15-(GGGGS)₁ x human IL15Rα(Sushi)-(GGGGS)₁ Fc heterodimer

Chain 1 - human_IL15_(GGGGS)₁_Fc(216)_IgG1_pI(-)_Isosteric_A_C220S/PVA_/S267K/L368D/K370S (15902) (SEQ ID NOS 221-223)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK Chain 2 - human_IL15Rα(Sushi)_(GGGGS)₁_Fc(216)_IgG1_C220S/PVA_/S267K/S364K/E357Q (15908) (SEQ ID NOS 224-226)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP21475 – human IL15 x human IL15Rα(Sushi) Fc heterodimer Chain 1 - human_IL15-Fc(216)_IgG1_pI(-)_Isosteric_A_C220S/PVA_/S267K/L368D/K370S (16479) (SEQ ID NOS 227-229)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVMHEALHNHYTQKSLSLSPGK Chain 2 - human_IL15Rα(Sushi)-Fc(216)_IgG1_C220S/PVA_/S267K/S364K/E357Q (16481) (SEQ ID NOS 230-232)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 23

>XENP21478 – human IL15Rα(Sushi)-(GGGGS)₆-human IL15(single-chain) Fc heterodimer Chain 1 - human_IL15Rα(sushi)_(GGGGS)₆-human_IL15-Fc(216)_IgG1_pI(-)_Isosteric_A_C220S/PVA_/S267K/L368D/K370S (16478) (SEQ ID NOS 233-236)
ITCPPPMSVEHADIWVKSYSLYSRERYICNSGFKRKAGTSSLTECVLNKATNVAHWTTPSLKCIR/GGGGSGGGGSG
GGGSGGGGSGGGGSGGGGS/NWVNVISDLKKIEDLIQSMHIDATLYTESDVHPSCKVTAMKCFLLELQVISLESGDA
SIHDTVENLIILANNSLSSNGNVTESGCKECEELEEKNIKEFLQSFVHIVQMFINTS/EPKSSDKTHTCPPCPAPPV
AGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK Chain 2 - empty-Fc(216)_IgG1_C220S/PVA_/S267K/S364K/E357Q (8924) (SEQ ID NO: 237)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 24

>XENP21479 – empty-Fc-IL15(non-covalent)-human_IL15Rα(Sushi) Fc heterodimer

Chain 1 - human_IL15_no_tag (16484) (SEQ ID NO: 238)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 239)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 3 - human_IL15Rα(Sushi)-Fc(216)_IgG1_C220S/PVA_/S267K/S364K/E357Q (16481) (SEQ ID NOS 240-242)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK >XENP022366 – empty-Fc-IL15(non-covalent)-human_IL15Ra(sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_no_tag (16484) (SEQ ID NO: 243)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 244)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 3 - human_IL15Ra(Sushi)_(GGGGS)1_Fc(216)_IgG1_C220S/PVA_/S267K/S364K/E357Q (15908) (SEQ ID NOS 245-247)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024348 IL15(non-covalent)-human_IL15Ra(Sushi)_empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL15 WT (SEQ ID NO: 248)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS

Chain 2 – human_IL15Ra(Sushi)_Fc(216)_IgG1_pI(-)_Isosteric_A_C220S/PVA_/S267K/L368D/K370S (SEQ ID NOS 249-251)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 3 – empty_Fc(216)_IgG1_C220S/PVA_/S267K/S364K/E357Q (SEQ ID NO: 252)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 25

>XENP021978 – human_IL15(non-covalent)-human_IL15Ra(Sushi)_Fc(216)_IgG1_C220S/PVA_/S267K

Chain 1 - human_IL15Ra(Sushi)-Fc(216)_IgG1_C220S/PVA_/S267K (17023) (SEQ ID NOS 253-255)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Chain 2 - human_IL15_no_tag (16484) (SEQ ID NO: 256)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS

Figure 26 human_IL15(single-chain)-human_IL15Ra(Sushi)_Fc(216)_IgG1_C220S/PVA_/S267K (SEQ ID NOS 257-260)

NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS/GGGGS/ITCPPPMSVEHADIWVKSYSLYSRERYICNSGF
KRKAGTSSLTECVLNKATNVAHWTTPSLKCIR/EPKSSDKTHTCPPCPAPPVAGPSVFLFPPKPKDTLMISRTPEVT
CVVVDVKHEDPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

Figure 27

**>XENP022637 – empty-Fc(216)_IgG1_pI(-
)_Isosteric_A_C220S/PVA_/S267K/L368D/K370S_(GGGGS)2_IL15Ra(Sushi)_IL15(non-
covalent)_IgG1_ISO(+RR)_C220S/PVA_/S267K/S364K/E357Q**

Chain 1 - empty-Fc(216)_IgG1_pI(-)_Isosteric_A_C220S/PVA_/S267K/L368D/K370S_(GGGGS)2_IL15Ra(Sushi) (17603) (SEQ ID NOS 261-263)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK
/GGGGSGGGGS/ITCPPPMSVEHADIWVKSYSLYSRERYICNSGFKRKAGTSSLTECVLNKATNVAHWTTPSLKCIR

Chain 2 - empty-Fc(216)_IgG1_ISO(+RR)_C220S/PVA_/S267K/S364K/E357Q (8927) (SEQ ID NO: 264)
ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Chain 3 - human_IL15_no_tag (16484) (SEQ ID NO: 265)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS

Figure 28 empty-Fc(216)_IgG1_pI(-)_Isosteric_A_C220S/PVA_/S267K/L368D/K370S_(GGGGS)2_IL15Ra(Sushi)_IL15(single-chain)_IgG1_ISO(+RR)_C220S/PVA_/S267K/S364K/E357Q Chain 1 - empty-Fc(216)_IgG1_pI(-)_Isosteric_A_C220S/PVA_/S267K/L368D/K370S_(GGGGS)2_IL15Ra(Sushi)_IL15(single-chain) (SEQ ID NOS 266-269)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK
/<u>GGGGSGGGGS</u>/ITCPPPMSVEHADIWVKSYSLYSRERYICNSGFKRKAGTSSLTECVLNKATNVAHWTTPSLKCIR
/<u>GGGGS</u>/NWVNVISDLKKIEDLIQSMHIDATLYTESDVHPSCKVTAMKCFLLELQVISLESGDASIHDTVENLIILA
NNSLSSNGNVTESGCKECEELEEKNIKEFLQSFVHIVQMFINTS Chain 2 - empty-Fc(216)_IgG1_ISO(+RR)_C220S/PVA_/S267K/S364K/E357Q (8927) (SEQ ID NO: 270)
ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 32

IL-15Rα(sushi-D96)(SEQ ID NO: 271)
ITCPPPMSVEHADIWVKSYSLYSRERYICNSGFKRKAGTSSLTECVLNKATNVAHWTTPSLKCIRD

IL-15Rα(sushi-D96/P97) (SEQ ID NO: 272)
ITCPPPMSVEHADIWVKSYSLYSRERYICNSGFKRKAGTSSLTECVLNKATNVAHWTTPSLKCIRDP

IL-15Rα(sushi-D96/P97/A98) (SEQ ID NO: 273)
ITCPPPMSVEHADIWVKSYSLYSRERYICNSGFKRKAGTSSLTECVLNKATNVAHWTTPSLKCIRDPA

Figure 33

IL-15(E87C) (SEQ ID NO: 274)
NWVNVISDLKKIEDLIQSMHIDATLYTESDVHPSCKVTAMKCFLLELQVISLESGDASIHDTVENLIILANNSLSSN
GNVTESGCKCCEELEEKNIKEFLQSFVHIVQMFINTS

IL-15(V49C) (SEQ ID NO: 275)
NWVNVISDLKKIEDLIQSMHIDATLYTESDVHPSCKVTAMKCFLLELQCISLESGDASIHDTVENLIILANNSLSSN
GNVTESGCKECEELEEKNIKEFLQSFVHIVQMFINTS

IL-15(L52C) (SEQ ID NO: 276)
NWVNVISDLKKIEDLIQSMHIDATLYTESDVHPSCKVTAMKCFLLELQVISCESGDASIHDTVENLIILANNSLSSN
GNVTESGCKECEELEEKNIKEFLQSFVHIVQMFINTS

IL-15(E89C) (SEQ ID NO: 277)
NWVNVISDLKKIEDLIQSMHIDATLYTESDVHPSCKVTAMKCFLLELQVISLESGDASIHDTVENLIILANNSLSSN
GNVTESGCKECCELEEKNIKEFLQSFVHIVQMFINTS

IL-15(Q48C) (SEQ ID NO: 278)
NWVNVISDLKKIEDLIQSMHIDATLYTESDVHPSCKVTAMKCFLLELCVISLESGDASIHDTVENLIILANNSLSSN
GNVTESGCKECEELEEKNIKEFLQSFVHIVQMFINTS

IL-15(E53C) (SEQ ID NO: 279)
NWVNVISDLKKIEDLIQSMHIDATLYTESDVHPSCKVTAMKCFLLELQVISLCSGDASIHDTVENLIILANNSLSSN
GNVTESGCKECEELEEKNIKEFLQSFVHIVQMFINTS

IL-15(C42S) (SEQ ID NO: 280)
NWVNVISDLKKIEDLIQSMHIDATLYTESDVHPSCKVTAMKSFLLELQVISLESGDASIHDTVENLIILANNSLSSN
GNVTESGCKECEELEEKNIKEFLQSFVHIVQMFINTS

IL-15(L45C) (SEQ ID NO: 281)
NWVNVISDLKKIEDLIQSMHIDATLYTESDVHPSCKVTAMKCFLCELQVISLESGDASIHDTVENLIILANNSLSSN
GNVTESGCKECEELEEKNIKEFLQSFVHIVQMFINTS

Figure 34

IL-15Rα(sushi-D96/C97) (SEQ ID NO: 282)
ITCPPPMSVEHADIWVKSYSLYSRERYICNSGFKRKAGTSSLTECVLNKATNVAHWTTPSLKCIRDC

IL-15Rα(sushi-D96/P97/C98) (SEQ ID NO: 283)
ITCPPPMSVEHADIWVKSYSLYSRERYICNSGFKRKAGTSSLTECVLNKATNVAHWTTPSLKCIRDPC

IL-15Rα(sushi-D96/C97/A98) (SEQ ID NO: 284)
ITCPPPMSVEHADIWVKSYSLYSRERYICNSGFKRKAGTSSLTECVLNKATNVAHWTTPSLKCIRDCA

IL-15Rα(sushi-S40C) (SEQ ID NO: 285)
ITCPPPMSVEHADIWVKSYSLYSRERYICNSGFKRKAGTCSLTECVLNKATNVAHWTTPSLKCIR

IL-15Rα(sushi-K34C) (SEQ ID NO: 286)
ITCPPPMSVEHADIWVKSYSLYSRERYICNSGFCRKAGTSSLTECVLNKATNVAHWTTPSLKCIR

IL-15Rα(sushi-G38C) (SEQ ID NO: 287)
ITCPPPMSVEHADIWVKSYSLYSRERYICNSGFKRKACTSSLTECVLNKATNVAHWTTPSLKCIR

IL-15Rα(sushi-L42C) (SEQ ID NO: 288)
ITCPPPMSVEHADIWVKSYSLYSRERYICNSGFKRKAGTSSCTECVLNKATNVAHWTTPSLKCIR

IL-15Rα(sushi-A37C) (SEQ ID NO: 289)
ITCPPPMSVEHADIWVKSYSLYSRERYICNSGFKRKCGTSSLTECVLNKATNVAHWTTPSLKCIR dsIL-15/Rα-heteroFc
Example: XENP22013 dsIL-15/Rα-Fc
Example: XENP22357

Bivalent dsIL-15/Rα-Fc
Example: XENP22634

Fc-dsIL-15/Rα
Example: XENP22639

Figure 36A

>XENP022013 human_IL15_E87C_(GGGGS)1-human_IL15Ra(Sushi-D96/C97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S (SEQ ID NOS 290-292)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS/GGGGS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97)_(GGGGS)1_Fc(216)_IgG1_C220S/PVA_/S267K/S364K/E357Q (SEQ ID NOS 293-295)
ITCPPPMSVEHADIWVKSYSLYSRERYICNSGFKRKAGTSSLTECVLNKATNVAHWTTPSLKCIRDC/GGGGS/EPKSSDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

>XENP022014 human_IL15_E87C_(GGGGS)1-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S (SEQ ID NOS 296-298)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS/GGGGS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/P97/C98)_(GGGGS)1_Fc(216)_IgG1_C220S/PVA_/S267K/S364K/E357Q (SEQ ID NOS 299-301)
ITCPPPMSVEHADIWVKSYSLYSRERYICNSGFKRKAGTSSLTECVLNKATNVAHWTTPSLKCIRDPC/GGGGS/EPKSSDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

>XENP022015 human_IL15_E87C_(GGGGS)1-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S (SEQ ID NOS 302-304)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS/GGGGS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97/A98)_(GGGGS)1_Fc(216)_IgG1_C220S/PVA_/S267K/S364K/E357Q (SEQ ID NOS 305-307)
ITCPPPMSVEHADIWVKSYSLYSRERYICNSGFKRKAGTSSLTECVLNKATNVAHWTTPSLKCIRDCA/GGGGS/EPKSSDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

Figure 36B

>XENP022017 human_IL15_L52C_(GGGGS)1-human_IL15Ra(Sushi-S40C)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_L52C_(GGGGS)1-_Fc(216)_IgG1_pI(-)_Isosteric_A_C220S/PVA_/S267K/L368D/K370S (SEQ ID NOS 308-310)
NWVNVISDLKKIEDLIQSMHIDATLYTESDVHPSCKVTAMKCFLLELQVISCESGDASIHDTVENLIILANNSLSSNGNVTESGCKECEELEE
KNIKEFLQSFVHIVQMFINTS/GGGGS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 – human_IL15Ra(Sushi-S40C)_(GGGGS)1_Fc(216)_IgG1_C220S/PVA_/S267K/S364K/E357Q (SEQ ID NOS 311-313)
ITCPPPMSVEHADIWVKSYSLYSRERYICNSGFKRKAGTCSLTECVLNKATNVAHWTTPSLKCIR/GGGGS/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 37A

>XENP022358 – empty-Fc-IL15_E87C-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (17074) (SEQ ID NO: 314)
NWVNVISDLKKIEDLIQSMHIDATLYTESDVHPSCKVTAMKCFLLELQVISLESGDASIHDTVENLIILANNSLSSN
GNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 315)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 3 - human_IL15Ra(Sushi-D96/P97/C98)_(GGGGS)1_Fc(216)_IgG1_C220S/PVA_/S267K/S364K/E357Q (17039) (SEQ ID NOS 316-318)
ITCPPPMSVEHADIWVKSYSLYSRERYICNSGFKRKAGTSSLTECVLNKATNVAHWTTPSLKCIRDPC/GGGGS/EP
KSSDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK >XENP022359 – empty-Fc-IL15_E87C-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (17074) (SEQ ID NO: 319)
NWVNVISDLKKIEDLIQSMHIDATLYTESDVHPSCKVTAMKCFLLELQVISLESGDASIHDTVENLIILANNSLSSN
GNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 320)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 3 - human_IL15Ra(Sushi-D96/C97/A98)_(GGGGS)1_Fc(216)_IgG1_C220S/PVA_/S267K/S364K/E357Q (17040) (SEQ ID NOS 321-323)
ITCPPPMSVEHADIWVKSYSLYSRERYICNSGFKRKAGTSSLTECVLNKATNVAHWTTPSLKCIRDCA/GGGGS/EP
KSSDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK >XENP022361 – empty-Fc-IL15_L52C-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_L52C_no_tag (17072) (SEQ ID NO: 324)
NWVNVISDLKKIEDLIQSMHIDATLYTESDVHPSCKVTAMKCFLLELQVISCESGDASIHDTVENLIILANNSLSSN
GNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 325)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 37B

Chain 3 - human_IL15Ra(Sushi-S40C)_(GGGGS)1_Fc(216)_IgG1_C220S/PVA_/S267K/S364K/E357Q (17044) (SEQ ID NOS 326-328)
ITCPPPMSVEHADIWVKSYSLYSRERYICNSGFKRKAGTCSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP022684 empty-Fc-IL15_E87C-human_IL15Ra(Sushi-D96/C97/A98)_Fc(216)_IgG1_pI(-)_Isosteric_A_C220S/PVA_/S267K/L368D/K370S-Fc(216)_IgG1_C220S/PVA_/S267K/S364K/E357Q Chain 1 – IL15_E87C (SEQ ID NO: 329)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS Chain 2 - IL15Ra(Sushi-D96/C97/A98)_Fc(216)_IgG1_pI(-)_Isosteric_A_C220S/PVA_/S267K/L368D/K370S (SEQ ID NOS 330-332)
ITCPPPMSVEHADIWVKSYSLYSRERYICNSGFKRKAGTSSLTECVLNKATNVAHWTTPSLKCIRDCA/EPKSSDKTHTCPPCPAPPVAGPSV
FLFPPKPKDTLMISRTPEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Figure 38

>XENP022634 – human_IL15(E87C)-human_IL15Ra(Sushi-D96/C97)_Fc(216)_IgG1_C220S/PVA_/S267K

Chain 1 - human_IL15Ra(Sushi-D96/C97)-Fc(216)_IgG1_C220S/PVA_/S267K (17581) (SEQ ID NOS 333-335)
ITCPPPMSVEHADIWVKSYSLYSRERYICNSGFKRKAGTSSLTECVLNKATNVAHWTTPSLKCIRDC/EPKSSDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREEMTKNQVSLTCLVKGFYPSDIAV
EWESNGQPENNYKTTPPVLDSDGSFFLYSKLTVDKSRWQQGNVFSCSVMHEALHNHYTQKSLSLSPGK Chain 2 - human_IL15_E87C_no_tag (17074) (SEQ ID NO: 336)
NWVNVISDLKKIEDLIQSMHIDATLYTESDVHPSCKVTAMKCFLLELQVISLESGDASIHDTVENLIILANNSLSSN
GNVTESGCKCCEELEEKNIKEFLQSFVHIVQMFINTS

>XENP022635 – human_IL15(E87C)-human_IL15Ra(Sushi-D96/C97/A98)_Fc(216)_IgG1_C220S/PVA_/S267K

Chain 1 - human_IL15Ra(Sushi-D96/C97/A98)-Fc(216)_IgG1_C220S/PVA_/S267K (17582) (SEQ ID NOS 337-339)
ITCPPPMSVEHADIWVKSYSLYSRERYICNSGFKRKAGTSSLTECVLNKATNVAHWTTPSLKCIRDCA/EPKSSDKT
HTCPPCPAPPVAGPSVFLFPPKPKDTLMISRTPEVTCVVVDVKHEDPEVKFNWYVDGVEVHNAKTKPREEQYNSTYR
VVSVLTVLHQDWLNGKEYKCKVSNKALPAPIEKTISKAKGQPREPQVYTLPPSREEMTKNQVSLTCLVKGFYPSDIA
VEWESNGQPENNYKTTPPVLDSDGSFFLYSKLTVDKSRWQQGNVFSCSVMHEALHNHYTQKSLSLSPGK Chain 2 - human_IL15_E87C_no_tag (17074) (SEQ ID NO: 340)
NWVNVISDLKKIEDLIQSMHIDATLYTESDVHPSCKVTAMKCFLLELQVISLESGDASIHDTVENLIILANNSLSSN
GNVTESGCKCCEELEEKNIKEFLQSFVHIVQMFINTS

>XENP022636 – human_IL15(L52C)-human_IL15Ra(Sushi-S40C)_Fc(216)_IgG1_C220S/PVA_/S267K

Chain 1 - human_IL15Ra(Sushi-S40C)-Fc(216)_IgG1_C220S/PVA_/S267K (17583) (SEQ ID NOS 341-343)
ITCPPPMSVEHADIWVKSYSLYSRERYICNSGFKRKAGTCSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK Chain 2 - human_IL15_L52C_no_tag (17072) (SEQ ID NO: 344)
NWVNVISDLKKIEDLIQSMHIDATLYTESDVHPSCKVTAMKCFLLELQVISCESGDASIHDTVENLIILANNSLSSN
GNVTESGCKECEELEEKNIKEFLQSFVHIVQMFINTS

Figure 39

>XENP022639 – empty-Fc(216)_IgG1_pI(-)_Isosteric_A_C220S/PVA_/S267K/L368D/K370S_(GGGGS)2_IL15Ra(Sushi-D96/C97)_IL15(E87C)_IgG1_ISO(+RR)_C220S/PVA_/S267K/S364K/E357Q

Chain 1 - empty-Fc(216)_IgG1_pI(-)_Isosteric_A_C220S/PVA_/S267K/L368D/K370S_(GGGGS)2_IL15Ra(Sushi-D96/C97) (17605) (SEQ ID NOS 345-347)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK
/GGGGSGGGGS/ITCPPPMSVEHADIWVKSYSLYSRERYICNSGFKRKAGTSSLTECVLNKATNVAHWTTPSLKCIR
DC Chain 2 - empty-Fc(216)_IgG1_ISO(+RR)_C220S/PVA_/S267K/S364K/E357Q (8927) (SEQ ID NO: 348)
ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK Chain 3 - human_IL15_E87C_no_tag (17074) (SEQ ID NO: 349)
NWVNVISDLKKIEDLIQSMHIDATLYTESDVHPSCKVTAMKCFLLELQVISLESGDASIHDTVENLIILANNSLSSN
GNVTESGCKCCEELEEKNIKEFLQSFVHIVQMFINTS

>XENP022640 empty-Fc(216)_IgG1_pI(-)_Isosteric_A_C220S/PVA_/S267K/L368D/K370S_IgG1_ISO(+RR)_C220S/PVA_/S267K/S364K/E357Q_(GGGGS)2_IL15Ra(Sushi-D96/C97)_IL15(E87C)

Chain 1 – IL15 (SEQ ID NO: 350)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS Chain 2 – empty_Fc(216)_IgG1_pI(-)_Isosteric_A_C220S/PVA_/S267K/L368D/K370S (SEQ ID NO: 351)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

Figure 43A

N1D (SEQ ID NO: 352)
DWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

N4D (SEQ ID NO: 353)
NWVDVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

D8N (SEQ ID NO: 354)
NWVNVISNLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

D30N (SEQ ID NO: 355)
NWVNVISDLKKIEDLIQSMHIDATLYTESNVHPSCKVTAMKCFLLELQVISLESGDASIHDTVENLIILANNSLSSNGNVTESGCKECEELEE
KNIKEFLQSFVHIVQMFINTS

D61N (SEQ ID NO: 356)
NWVNVISDLKKIEDLIQSMHIDATLYTESDVHPSCKVTAMKCFLLELQVISLESGDASIHNTVENLIILANNSLSSNGNVTESGCKECEELEE
KNIKEFLQSFVHIVQMFINTS

E64Q (SEQ ID NO: 357)
NWVNVISDLKKIEDLIQSMHIDATLYTESDVHPSCKVTAMKCFLLELQVISLESGDASIHDTVQNLIILANNSLSSNGNVTESGCKECEELEE
KNIKEFLQSFVHIVQMFINTS

N65D (SEQ ID NO: 358)
NWVNVISDLKKIEDLIQSMHIDATLYTESDVHPSCKVTAMKCFLLELQVISLESGDASIHDTVEDLIILANNSLSSNGNVTESGCKECEELEE
KNIKEFLQSFVHIVQMFINTS

Q108E (SEQ ID NO: 359)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVEMFINTS

N1D/D61N (SEQ ID NO: 360)
DWVNVISDLKKIEDLIQSMHIDATLYTESDVHPSCKVTAMKCFLLELQVISLESGDASIHNTVENLIILANNSLSSNGNVTESGCKECEELEE
KNIKEFLQSFVHIVQMFINTS

N1D/E64Q (SEQ ID NO: 361)
DWVNVISDLKKIEDLIQSMHIDATLYTESDVHPSCKVTAMKCFLLELQVISLESGDASIHDTVQNLIILANNSLSSNGNVTESGCKECEELEE
KNIKEFLQSFVHIVQMFINTS

N4D/D61N (SEQ ID NO: 362)
NWVDVISDLKKIEDLIQSMHIDATLYTESDVHPSCKVTAMKCFLLELQVISLESGDASIHNTVENLIILANNSLSSNGNVTESGCKECEELEE
KNIKEFLQSFVHIVQMFINTS

N4D/E64Q (SEQ ID NO: 363)
NWVDVISDLKKIEDLIQSMHIDATLYTESDVHPSCKVTAMKCFLLELQVISLESGDASIHDTVQNLIILANNSLSSNGNVTESGCKECEELEE
KNIKEFLQSFVHIVQMFINTS

D8N/D61N (SEQ ID NO: 364)
NWVNVISNLKKIEDLIQSMHIDATLYTESDVHPSCKVTAMKCFLLELQVISLESGDASIHNTVENLIILANNSLSSNGNVTESGCKECEELEE
KNIKEFLQSFVHIVQMFINTS

Figure 43B

D8N/E64Q (SEQ ID NO: 365)
NWVNVISNLKKIEDLIQSMHIDATLYTESDVHPSCKVTAMKCFLLELQVISLESGDASIHDTVQNLIILANNSLSSNGNVTESGCKECEELEE
KNIKEFLQSFVHIVQMFINTS

D61N/E64Q (SEQ ID NO: 366)
NWVNVISDLKKIEDLIQSMHIDATLYTESDVHPSCKVTAMKCFLLELQVISLESGDASIHNTVQNLIILANNSLSSNGNVTESGCKECEELEE
KNIKEFLQSFVHIVQMFINTS

E64Q/Q108E (SEQ ID NO: 367)
NWVNVISDLKKIEDLIQSMHIDATLYTESDVHPSCKVTAMKCFLLELQVISLESGDASIHDTVQNLIILANNSLSSNGNVTESGCKECEELEE
KNIKEFLQSFVHIVEMFINTS

N1D/N4D/D8N (SEQ ID NO: 368)
DWVDVISNLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

D61N/E64Q/N65D (SEQ ID NO: 369)
NWVNVISDLKKIEDLIQSMHIDATLYTESDVHPSCKVTAMKCFLLELQVISLESGDASIHNTVQDLIILANNSLSSNGNVTESGCKECEELEE
KNIKEFLQSFVHIVQMFINTS

N1D/D61N/E64Q/Q108E (SEQ ID NO: 370)
DWVNVISDLKKIEDLIQSMHIDATLYTESDVHPSCKVTAMKCFLLELQVISLESGDASIHNTVQNLIILANNSLSSNGNVTESGCKECEELEE
KNIKEFLQSFVHIVEMFINTS

N4D/D61N/E64Q/Q108E (SEQ ID NO: 371)
NWVDVISDLKKIEDLIQSMHIDATLYTESDVHPSCKVTAMKCFLLELQVISLESGDASIHNTVQNLIILANNSLSSNGNVTESGCKECEELEE
KNIKEFLQSFVHIVEMFINTS

N1D/N65D (SEQ ID NO: 372)
DWVNVISDLKKIEDLIQSMHIDATLYTESDVHPSCKVTAMKCFLLELQVISLESGDASIHDTVEDLIILANNSLSSNGNVTESGCKECEELEE
KNIKEFLQSFVHIVQMFINTS

N1D/Q108E (SEQ ID NO: 373)
DWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVEMFINTS

N4D/N65D (SEQ ID NO: 374)
NWVDVISDLKKIEDLIQSMHIDATLYTESDVHPSCKVTAMKCFLLELQVISLESGDASIHDTVEDLIILANNSLSSNGNVTESGCKECEELEE
KNIKEFLQSFVHIVQMFINTS

D30N/N65D (SEQ ID NO: 375)
NWVNVISDLKKIEDLIQSMHIDATLYTESNVHPSCKVTAMKCFLLELQVISLESGDASIHDTVEDLIILANNSLSSNGNVTESGCKECEELEE
KNIKEFLQSFVHIVQMFINTS

D30N/Q108E (SEQ ID NO: 376)
NWVNVISDLKKIEDLIQSMHIDATLYTESNVHPSCKVTAMKCFLLELQVISLESGDASIHDTVENLIILANNSLSSNGNVTESGCKECEELEE
KNIKEFLQSFVHIVEMFINTS

N65D/Q108E (SEQ ID NO: 377)
NWVNVISDLKKIEDLIQSMHIDATLYTESDVHPSCKVTAMKCFLLELQVISLESGDASIHDTVEDLIILANNSLSSNGNVTESGCKECEELEE
KNIKEFLQSFVHIVEMFINTS

Figure 43C

E64Q/N65D (SEQ ID NO: 378)
NWVNVISDLKKIEDLIQSMHIDATLYTESDVHPSCKVTAMKCFLLELQVISLESGDASIHDTVQDLIILANNSLSSNGNVTESGCKECEELEE
KNIKEFLQSFVHIVQMFINTS

N1D/N4D/N65D (SEQ ID NO: 379)
DWVDVISDLKKIEDLIQSMHIDATLYTESDVHPSCKVTAMKCFLLELQVISLESGDASIHDTVEDLIILANNSLSSNGNVTESGCKECEELEE
KNIKEFLQSFVHIVQMFINTS

D30N/E64Q/N65D (SEQ ID NO: 380)
NWVNVISDLKKIEDLIQSMHIDATLYTESNVHPSCKVTAMKCFLLELQVISLESGDASIHDTVQDLIILANNSLSSNGNVTESGCKECEELEE
KNIKEFLQSFVHIVQMFINTS

N4D/D61N/N65D (SEQ ID NO: 381)
NWVDVISDLKKIEDLIQSMHIDATLYTESDVHPSCKVTAMKCFLLELQVISLESGDASIHNTVEDLIILANNSLSSNGNVTESGCKECEELEE
KNIKEFLQSFVHIVQMFINTS

Figure 44A

>XENP022821 - human_IL15_N65D_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N65D_(GGGGS)₁ (17692) (SEQ ID NOS 382-384)
NWVNVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 385-387)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP022822 - human_IL15_Q108E_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_Q108E_(GGGGS)₁ (17693) (SEQ ID NOS 388-390)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVEMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 391-393)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP023554 - human_IL15_N1D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N1D/N65D_(GGGGS)1_Fc(216)_IgG1_pI(-)_Isosteric_A_C220S/PVA_/S267K/L368D/K370S (18783) (SEQ ID NOS 394-396)
DWVNVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NOS 397-399)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 44B

>XENP023557 - human_IL15_N4D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N4D/N65D_(GGGGS)1_Fc(216)_IgG1_pI(-)_Isosteric_A_C220S/PVA_/S267K/L368D/K370S (18786) (SEQ ID NOS 400-402)
NWVDVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NOS 403-405)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP023561 human_IL15_N65D/Q108E_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N65D/Q108E_(GGGGS)1_Fc(216)_IgG1_pI(-)_Isosteric_A_C220S/PVA_/S267K/L368D/K370S (SEQ ID NOS 406-408)
NWVNVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVEMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (SEQ ID NOS 409-411)
ITCPPPMSVEHADIWVKSYSLYSRERYICNSGFKRKAGTSSLTECVLNKATNVAHWTTPSLKCIR/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK >XENP024018 human_IL15(N65D)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15(N65D)_Fc(216)_IgG1_pI(-)_Isosteric_A_C220S/PVA_/S267K/L368D/K370S (SEQ ID NOS 412-414)
NWVNVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (SEQ ID NOS 415-417)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 44C

>XENP024019 - human_IL15(Q108E)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15(Q108E)-human_IL15Ra(Sushi)_Fc(216)_IgG1_pI(-
)_Isosteric_A_C220S/PVA_/S267K/L368D/K370S (19242) (SEQ ID NOS 418-420)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVEMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (16481) (SEQ ID NOS 421-423)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK >XENP024045 human_IL15_D30N/E64Q/N65D_(GGGGS)1-human_IL15Rα(Sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_D30N/E64Q/N65D_(GGGGS)1_Fc(216)_IgG1_pI(-
)_Isosteric_A_C220S/PVA_/S267K/L368D/K370S (SEQ ID NOS 424-426)
NWVNVISDLKKIEDLIQSMHIDATLYTESNVHPSCKVTAMKCFLLELQVISLESGDASIHDTVQDLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK Chain 2 – human_IL15Rα(Sushi)_(GGGGS)1_Fc(216)_IgG1_C220S/PVA_/S267K/S364K/E357Q (SEQ ID NOS 427-
429)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024051 human_IL15_N1D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N1D/N65D-human_Fc(216)_IgG1_pI(-)_Isosteric_A_C220S/PVA_/S267K/L368D/K370S
(SEQ ID NOS 430-432)
DWVNVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NOS 433-435)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 44D

>XENP024052 human_IL15_N4D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N4D/N65D-human_ Fc(216)_IgG1_pI(-)_Isosteric_A_C220S/PVA_/S267K/L368D/K370S
(SEQ ID NOS 436-438)
NWVDVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NOS 439-441)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 45A

>XENP024015 human_IL15Ra(sushi)_(GGGGS)5-human_IL15(Q108E;single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)5-human_IL15(Q108E;single-chain)_Fc(216)_IgG1_pI(-)_Isosteric_A_C220S/PVA_/S267K/L368D/K370S (SEQ ID NOS 442-445)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVNVISDLKKIEDLIQSMHIDATLYTESDVHPSCKVTAMKCFLLELQVISLESGDASIHDT
VENLIILANNSLSSNGNVTESGCKECEELEEKNIKEFLQSFVHIVEMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 446)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >XENP024050 human_IL15Ra(sushi)_(GGGGS)5-human_IL15_N4D/N65D_(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)5-human_IL15_N4D/N65D_(single-chain)_Fc(216)_IgG1_pI(-)_Isosteric_A_C220S/PVA_/S267K/L368D/K370S (SEQ ID NOS 447-450)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVDVISDLKKIEDLIQSMHIDATLYTESDVHPSCKVTAMKCFLLELQVISLESGDASIHDT
VEDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 451)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >XENP024475 human_IL15Ra(sushi)_(GGGGS)6-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)6-human_IL15(single-chain;Q108E)_Fc(216)_IgG1_pI(-)_Isosteric_A_C220S/PVA_/S267K/L368D/K370S (SEQ ID NOS 452-455)
ITCPPPMSVEHADIWVKSYSLYSRERYICNSGFKRKAGTSSLTECVLNKATNVAHWTTPSLKCIR/GGGGSGGGGSG
GGGSGGGGSGGGGSGGGGS/NWVNVISDLKKIEDLIQSMHIDATLYTESDVHPSCKVTAMKCFLLELQVISLESGDA
SIHDTVENLIILANNSLSSNGNVTESGCKECEELEEKNIKEFLQSFVHIVEMFINTS/EPKSSDKTHTCPPCPAPPV
AGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 456)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 45B

>XENP024476 human_IL15Ra(sushi)_(GGGGS)6-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain;N4D/N65D)_Fc(216)_IgG1_pI(-)_Isosteric_A_C220S/PVA_/S267K/L368D/K370S (SEQ ID NOS 457-460)
ITCPPPMSVEHADIWVKSYSLYSRERYICNSGFKRKAGTSSLTECVLNKATNVAHWTTPSLKCIR/<u>GGGGSGGGGSG
GGGSGGGGSGGGGSGGGGS</u>/NWVDVISDLKKIEDLIQSMHIDATLYTESDVHPSCKVTAMKCFLLELQVISLESGDA
SIHDTVEDLIILANNSLSSNGNVTESGCKECEELEEKNIKEFLQSFVHIVQMFINTS/EPKSSDKTHTCPPCPAPPV
AGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 461)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP024478 human_IL15Ra(sushi)_(GGGGS)7-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)7-human_IL15(single-chain;Q108E)_Fc(216)_IgG1_pI(-)_Isosteric_A_C220S/PVA_/S267K/L368D/K370S (SEQ ID NOS 462-465)
ITCPPPMSVEHADIWVKSYSLYSRERYICNSGFKRKAGTSSLTECVLNKATNVAHWTTPSLKCIR/<u>GGGGSGGGGSG
GGGSGGGGSGGGGSGGGGSGGGGS</u>/NWVNVISDLKKIEDLIQSMHIDATLYTESDVHPSCKVTAMKCFLLELQVISL
ESGDASIHDTVENLIILANNSLSSNGNVTESGCKECEELEEKNIKEFLQSFVHIVEMFINTS/EPKSSDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 466)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP024479 human_IL15Ra(sushi)_(GGGGS)7-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)7-human_IL15(single-chain;N4D/N65D)_Fc(216)_IgG1_pI(-)_Isosteric_A_C220S/PVA_/S267K/L368D/K370S (SEQ ID NOS 467-470)
ITCPPPMSVEHADIWVKSYSLYSRERYICNSGFKRKAGTSSLTECVLNKATNVAHWTTPSLKCIR/<u>GGGGSGGGGSG
GGGSGGGGSGGGGSGGGGSGGGGS</u>/NWVDVISDLKKIEDLIQSMHIDATLYTESDVHPSCKVTAMKCFLLELQVISL
ESGDASIHDTVEDLIILANNSLSSNGNVTESGCKECEELEEKNIKEFLQSFVHIVQMFINTS/EPKSSDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - empty-Fc_Fc(216)_IgG1_C220S/PVA_/S267K/S364K/E357Q (SEQ ID NO: 471)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 45C

>XENP024481 human_IL15Ra(sushi)_(30AA_linker_variant)-human_IL15(single-chain;Q108E)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(30AA_linker_variant)-human_IL15(single-chain;Q108E)_Fc(216)_IgG1_pI(-
)_Isosteric_A_C220S/PVA_/S267K/L368D/K370S (SEQ ID NOS 472-475)
ITCPPPMSVEHADIWVKSYSLYSRERYICNSGFKRKAGTSSLTECVLNKATNVAHWTTPSLKCIR/DPALVHQRPAP
PGGGGSGGGGSGGGGSGGG/NWVNVISDLKKIEDLIQSMHIDATLYTESDVHPSCKVTAMKCFLLELQVISLESGDA
SIHDTVENLIILANNSLSSNGNVTESGCKECEELEEKNIKEFLQSFVHIVEMFINTS/EPKSSDKTHTCPPCPAPPV
AGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK Chain 2 – empty_ Fc(216)_IgG1_C220S/PVA_/S267K/S364K/E357Q (SEQ ID NO: 476)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 46A

>XENP024349 IL15_Q108E_(non-covalent)-human_IL15Rα(Sushi)_empty-Fc_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15Rα(Sushi)_ Isosteric_A_C220S/PVA_/S267K/L368D/K370S (SEQ ID NOS 477-479)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 2 – empty- Fc(216)_IgG1_C220S/PVA_/S267K/S364K/E357Q (SEQ ID NO: 480)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK Chain 3 – IL15_Q108E_(non-covalent) (SEQ ID NO: 481)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVEMFINTS >XENP024890 IL15_N4D/N65D_(non-covalent)-human_IL15Ra(Sushi)-empty-Fc_IgG1_Fc(216)_IgG1_pI(-
)_Isosteric_A_C220S/PVA_/S267K/L368D/K370S-IgG1_PVA_/S267K/S364K/E357Q Chain 1 – IL-15_N4D/N65D (SEQ ID NOS 482-484)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 2 - human_IL15Ra(Sushi)_Fc(216)_IgG1_pI(-)_Isosteric_A_C220S/PVA_/S267K/L368D/K370S (SEQ ID NOS 485-487)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 3 – empty_Fc(216)_ IgG1_PVA_/S267K/S364K/E357Q (SEQ ID NO: 488)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >XENP25138 IL15_D30N/E64Q/N65D_(non-covalent)-empty-Fc_Fc(216)_IgG1_pI(-
)_Isosteric_A_C220S/PVA_/S267K/L368D/K370S-IgG1_PVA_/S267K/S364K/E357Q Chain 1 - IL15_D30N/E64Q/N65D (SEQ ID NO: 489)
NWVNVISDLKKIEDLIQSMHIDATLYTESNVHPSCKVTAMKCFLLELQVISLESGDASIHDTVQDLIILANNSLSSN
GNVTESGCKECEELEEKNIKEFLQSFVHIVQMFINTS Chain 2 - human_IL15Ra(Sushi)_Fc(216)_IgG1_pI(-)_Isosteric_A_C220S/PVA_/S267K/L368D/K370S (SEQ ID NOS 490-492)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Figure 46B

Chain 3 - empty_Fc(216)_ IgG1_PVA_/S267K/S364K/E357Q (SEQ ID NO: 493)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 47

>XENP022801 - human_IL15_N65D(non-covalent)-human_IL15Rα(Sushi)

Chain 1 - human_IL15_N65D(non-covalent) (17672) (SEQ ID NO: 494)
NWVNVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS

Chain 2 - human_IL15Rα(Sushi) (17033) (SEQ ID NO: 495)
ITCPPPMSVEHADIWVKSYSLYSRERYICNSGFKRKAGTSSLTECVLNKATNVAHWTTPSLKCIR

>XENP022802 - human_IL15_Q108E(non-covalent)-human_IL15Rα(Sushi)

Chain 1 - human_IL15_Q108E(non-covalent) (17673) (SEQ ID NO: 496)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVEMFINTS

Chain 2 - human_IL15Rα(Sushi) (17033) (SEQ ID NO: 497)
ITCPPPMSVEHADIWVKSYSLYSRERYICNSGFKRKAGTSSLTECVLNKATNVAHWTTPSLKCIR

Figure 48

>XENP024342 human_IL15(non-covalent; Q108E)-human_IL15Rα(Sushi)_Fc(216)_IgG1_C220S/PVA_/S267K

Chain 1 – human_IL15Rα(Sushi)_Fc(216)_IgG1_C220S/PVA_/S267K (SEQ ID NOS 498-500)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Chain 2 –human_IL15(non-covalent; Q108E) (SEQ ID NO: 501)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVEMFINTS

Figure 49

>XENP023472 empty-Fc-IL15_N65D/E87C-human_IL15Ra(Sushi-D96/C97)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – empty_ Fc(216)_IgG1_pI(-)_Isosteric_A_C220S/PVA_/S267K/L368D/K370S (SEQ ID NO: 502)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - IL15_N65D/E87C (SEQ ID NO: 503)
NWVNVISDLKKIEDLIQSMHIDATLYTESDVHPSCKVTAMKCFLLELQVISLESGDASIHDTVEDLIILANNSLSSN
GNVTESGCKCCEELEEKNIKEFLQSFVHIVQMFINTS Chain 3 - IL15Ra(Sushi-D96/C97)_Fc(216)_IgG1_C220S/PVA_/S267K/S364K/E357Q (SEQ ID NOS 504-506)
ITCPPPMSVEHADIWVKSYSLYSRERYICNSGFKRKAGTSSLTECVLNKATNVAHWTTPSLKCIRDC/EPKSSDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK >XENP023473 empty-Fc-IL15_N65D/L52C-human_IL15Ra(Sushi-S40C)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – empty_ Fc(216)_IgG1_pI(-)_Isosteric_A_C220S/PVA_/S267K/L368D/K370S (SEQ ID NO: 507)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - IL15_N65D/L52C (SEQ ID NO: 508)
NWVNVISDLKKIEDLIQSMHIDATLYTESDVHPSCKVTAMKCFLLELQVISCESGDASIHDTVEDLIILANNSLSSN
GNVTESGCKECEELEEKNIKEFLQSFVHIVQMFINTS Chain 3 - IL15Ra(Sushi-S40C)_Fc(216)_IgG1_C220S/PVA_/S267K/S364K/E357Q (SEQ ID NOS 509-511)
ITCPPPMSVEHADIWVKSYSLYSRERYICNSGFKRKAGTCSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 51

| XENP | Variant | EC50 pM (NK cells) | Fold reduced (NK cells) | EC50 pM (CD8 T cells) | Fold reduced (CD8 T cells) |
| --- | --- | --- | --- | --- | --- |
| 20818 | WT | 200.6 | | 637.1 | |
| 21478 | single-chain | 848.5 | 4.2 | 4982.0 | 7.8 |
| 22815 | N1D | 281.3 | 1.4 | 1051.0 | 1.6 |
| 22816 | N4D | 321.9 | 1.6 | 1190.0 | 1.9 |
| 22817 | D8N | very weak | very weak | very weak | very weak |
| 22818 | D30N | 376.3 | 1.9 | 1366.0 | 2.1 |
| 22819 | D61N | 5934.0 | 29.6 | 161937.0 | >100 |
| 22820 | E64Q | 877.0 | 4.4 | 2858.0 | 4.5 |
| 22821 | N65D | 2883.0 | 14.4 | 6928.0 | 10.9 |
| 22822 | Q108E | 9777.0 | 48.7 | very weak | >100 |
| 22823 | N1D/D61N | 918.0 | 4.6 | 4225.0 | 6.6 |
| 22824 | N1D/E64Q | 1091.0 | 5.4 | 4228.0 | 6.6 |
| 22825 | N4D/D61N | 309.0 | 1.5 | 1070.0 | 1.7 |
| 22826 | N4D/E64Q | very weak | very weak | very weak | very weak |
| 22827 | D8N/D61N | ND | ND | ND | ND |
| 22828 | D8N/E64Q | 597.7 | 3.0 | 1658.0 | 2.6 |
| 22829 | D61N/E64Q | 458.2 | 2.3 | 2115.0 | 3.3 |
| 22830 | E64Q/Q108E | 436.6 | 2.2 | 1815.0 | 2.8 |
| 22831 | N1D/N4D/D8N | very weak | very weak | very weak | very weak |
| 22832 | D61N/E64Q/N65D | ND | ND | ND | ND |
| 22833 | N1D/D61N/E64Q/Q108E | ND | ND | ND | ND |
| 22834 | N4D/D61N/E64Q/Q108E | very weak | very weak | very weak | very weak |

| XENP | EC50 nM (NK cells) | Fold reduced (NK cells) | EC50 nM (CD8 T cells) | Fold reduced (CD8 T cells) | EC50 nM (CD4 T cells) | Fold reduced (CD4 T cells) |
|---|---|---|---|---|---|---|
| 20818 | 0.3223 | 1.0 | 2.701 | 1.0 | 16.467 | 1.0 |
| 21478 | 1.116 | 3.5 | 11.728 | 4.3 | 28.349 | 1.7 |
| 22818 | 0.4205 | 1.3 | 2.829 | 1.0 | 40.676 | 2.5 |
| 22819 | 1.016 | 3.2 | 8.254 | 3.1 | 18.101 | 1.1 |
| 22820 | 0.562 | 1.7 | 3.918 | 1.5 | 10.362 | 0.6 |
| 22821 | 3.14 | 9.7 | 18.706 | 6.9 | 112.823 | 6.9 |
| 22822 | 68.866 | 213.7 | 6439.69 | 2384.2 | 48.738 | 3.0 |
| 22825 | 1.769 | 5.5 | 12.09 | 4.5 | 60.081 | 3.6 |
| 22826 | 1.448 | 4.5 | 9.678 | 3.6 | 22.41 | 1.4 |
| 22829 | 4.839 | 15.0 | 29.638 | 11.0 | 337.571 | 20.5 |
| 22834 | 331.293 | 1027.9 | 4107.897 | 1520.9 | ND | ND |
| IL-15 | 0.05322 | 0.2 | 0.3452 | 0.1 | ND | ND | scIL-15/Rα x scFv
Example: XENP21480 scFv x ncIL-15/Rα scFv x dsIL-15/Rα scIL-15/Rα x Fab
Example: XENP22022

Fab x ncIL-15/Rα
Example: XENP22112

Fab x dsIL-15/Rα
Example: XENP22641 mAb-scIL-15/Rα

Example: XENP22642 mAb-ncIL-15/Rα
Example: XENP22642 mAb-dsIL-15/Rα
Example: XENP22644 central-IL-15/Rα central-scIL-15/Rα

Figure 65

XENP021480 human_IL15Ra(sushi)_(GGGGS)6-human_IL15(single-chain)-
1G6_L1.194_H1.279_scFv(GKPGS)4_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)6-human_IL15(single-chain)_IgG1_pI(-
)_Isosteric_A_C220S/PVA_/S267K/L368D/K370S (SEQ ID NOS 512-515)

ITCPPPMSVEHADIWVKSYSLYSRERYICNSGFKRKAGTSSLTECVLNKATNVAHWTTPSLKCIR/GGGGSGGGGSGGGGSGGGGSGGGGSGG
GGS/NWVNVISDLKKIEDLIQSMHIDATLYTESDVHPSCKVTAMKCFLLELQVISLESGDASIHDTVENLIILANNSLSSNGNVTESGCKECE
ELEEKNIKEFLQSFVHIVQMFINTS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK

Chain2 -1G6_L1.194_H1.279_scFv(GKPGS)4_IgG1_C220S/PVA_/S267K/S364K/E357Q (SEQ ID NOS 516-525)
EIVLTQSPATLSASPGERVTLTCRASQSVGNDVAWYQQKPGQAPRLLINYASHRYTGVPDRFTGSGYGTEFTLTISSVQSEDFGVYYC**QQDFS
SPRTFGGGTKVEIK/GKPGSGKPGSGKPGSGKPGS/EVQLVESGGGLVKPGGSLRLSCVASGFTFSNYWMNWVRQAPGKGLEWVAEIRLYSNN
YATHYAESVKGRFTISRDDSKSTLYLQMNNLKTEDTGVYYCTRYYGNYGGYFDV**WGRGTLVTVSS/EPKSSDKTHTCPPCPAPPVAGPSVFLF
PPKPKDTLMISRTPEVTCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Figure 66

1G6_L1.194_H1.279_scFv(GKPGS)4-human_IL15Ra(sushi)_(GGGGS)6-human_IL15(non-
covalent)_Fc(216)_IgG1_pI(-)_Isosteric_A_C220S/PVA_/S267K/L368D/K370S-
Fc(216)_IgG1_C220S/PVA_/S267K/S364K/E357Q Chain 1 – 1G6_L1.194_H1.279_scFv(GKPGS)4_ Fc(216)_IgG1_pI(-)_Isosteric_A_C220S/PVA_/S267K/L368D/K370S
(SEQ ID NOS 526-535)
EIVLTQSPATLSASPGERVTLTCRASQSVGNDVAWYQQKPGQAPRLLINYASHRYTGVPDRFTGSGYGTEFTLTISSVQSEDFGVYYC**QQDFS
SPRTFGGGTKVEIK/GKPGSGKPGSGKPGSGKPGS/EVQLVESGGGLVKPGGSLRLSCVASGFTFSNYWMNWVRQAPGKGLEWVAEIRLYSNN
YATHYAESVKGRFTISRDDSKSTLYLQMNNLKTEDTGVYYCTRYYGNYGGYFDV**WGRGTLVTVSS/EPKSSDKTHTCPPCPAPPVAGPSVFLF
PPKPKDTLMISRTPEVTCVVVDVKHEDPEVKFNWYVDGVEVHNAKTKPREEEYNSTYRVVSVLTVLHQDWLNGKEYKCKVSNKALPAPIEKTI
SKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK Chain2-human_IL15Ra(sushi)_(GGGGS)6_ Fc(216)_IgG1_C220S/PVA_/S267K/S364K/E357Q (SEQ ID NOS 536-538)
ITCPPPMSVEHADIWVKSYSLYSRERYICNSGFKRKAGTSSLTECVLNKATNVAHWTTPSLKCIR/GGGGSGGGGSGGGGSGGGGSGGGGSGG
GGS/EPKSSDKTHTCPPCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK Chain 3 – IL-15 (SEQ ID NO: 539)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

Figure 67

1G6_L1.194_H1.279_scFv(GKPGS)4-human_IL15Ra(sushi-D96/C97/A98)-human_IL15(E87C)_Fc(216)_IgG1_pI(-)_Isosteric_A_C220S/PVA_/S267K/L368D/K370S-Fc(216)_IgG1_C220S/PVA_/S267K/S364K/E357Q Chain 1 – 1G6_L1.194_H1.279_scFv(GKPGS)4_ Fc(216)_IgG1_pI(-)_Isosteric_A_C220S/PVA_/S267K/L368D/K370S (SEQ ID NOS 540-549)
EIVLTQSPATLSASPGERVTLTCRASQSVGNDVAWYQQKPGQAPRLLINYASHRYTGVPDRFTGSGYGTEFTLTISSVQSEDFGVYYCQQDFS SPRTFGGGTKVEIK/GKPGSGKPGSGKPGSGKPGS/EVQLVESGGGLVKPGGSLRLSCVASGFTFSNYWMNWVRQAPGKGLEWVAEIRLYSNN YATHYAESVKGRFTISRDDSKSTLYLQMNNLKTEDTGVYYCTRYYGNYGGYFDVWGRGTLVTVSS/EPKSSDKTHTCPPCPAPPVAGPSVFLF PPKPKDTLMISRTPEVTCVVVDVKHEDPEVKFNWYVDGVEVHNAKTKPREEEYNSTYRVVSVLTVLHQDWLNGKEYKCKVSNKALPAPIEKTI SKAKGQPREPQVYTLPPSREEMTKNQVSLTCDVSGFYPSDIAVEWESDGQPENNYKTTPPVLDSDGSFFLYSKLTVDKSRWEQGDVFSCSVMH EALHNHYTQKSLSLSPGK Chain2-human_IL15Ra(sushi-D96/C97/A98)_ Fc(216)_IgG1_C220S/PVA_/S267K/S364K/E357Q (SEQ ID NOS 550-552)
ITCPPPMSVEHADIWVKSYSLYSRERYICNSGFKRKAGTSSLTECVLNKATNVAHWTTPSLKCIRDCA/EPKSSDKTHTCPPCPAPPVAGPSV FLFPPKPKDTLMISRTPEVTCVVVDVKHEDPEVKFNWYVDGVEVHNAKTKPREEQYNSTYRVVSVLTVLHQDWLNGKEYKCKVSNKALPAPIE KTISKAKGQPREPQVYTLPPSREQMTKNQVKLTCLVKGFYPSDIAVEWESNGQPENNYKTTPPVLDSDGSFFLYSKLTVDKSRWQQGNVFSCS VMHEALHNHYTQKSLSLSPGK Chain 3—IL-15(E87C)(SEQ ID NO: 553)
NWVNVISDLKKIEDLIQSMHIDATLYTESDVHPSCKVTAMKCFLLELQVISLESGDASIHDTVENLIILANNSLSSNGNVTESGCKCCEELEE KNIKEFLQSFVHIVQMFINTS

Figure 68A

<u>XENP022022human_IL15Ra(sushi)_(GGGGS)6-human_IL15(single-chain)-1G6_H1.278_L1.188_[PD-1]_Fab_IgG1_pI(-)_Isosteric_A_/PVA_/S267K/L368D/K370S-Fc(216)_IgG1_C220S/PVA_/S267K/S364K/E357Q</u>

Chain 1 - human_IL15Ra(sushi)_(GGGGS)6-human_IL15(single-chain)_ IgG1_pI(-)_Isosteric_A_/PVA_/S267K/L368D/K370S (SEQ ID NOS 554-557)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGSGG</u>
<u>GGS</u>/NWVNVISDLKKIEDLIQSMHIDATLYTESDVHPSCKVTAMKCFLLELQVISLESGDASIHDTVENLIIANNSLSSNGNVTESGCKECE
ELEEKNIKEFLQSFVHIVQMFINTS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK Chain2-1G6_H1.278 [PD-1]_IgG1_C220S/PVA_/S267K/S364K/E357Q (SEQ ID NOS 558-562)
EVQLVESGGGLVKPGGSLRLSCVASGFTFSNYWMNWVRQAPGKGLEWVAEIRLYSNNYATHYAESVKGRFTISRDDSKSTLYLQMNNLKTEDT
GVYYCTRYYGNYGGYFDVWGQGTLVTVSS/ASTKGPSVFPLAPSSKSTSGGTAALGCLVKDYFPEPVTVSWNSGALTSGVHTFPAVLQSSGLY
SLSSVVTVPSSSLGTQTYICNVNHKPSDTKVDKKVEPKSSDKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLSLSPGK Chain3-1G6_L1.188[PD-1] (SEQ ID NOS 563-567)
EIVMTQSPATLSVSPGERVTLTCRASQSVGNDVAWYQQKPGQSPRLLINYASHRYTGVPDRFTGSGYGTEFTLTISSVQSEDFAVYFCQQDFS
SPRTFGGGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC <u>XENP025849human_IL15Ra(sushi)_(GGGGS)5-human_IL15(single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q</u>

Chain 1 - 1C11[PD-1]_H3_ IgG1_PVA_/S267K/S364K/E357Q (SEQ ID NOS 568-572)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain2- human_IL15Ra(sushi)_(GGGGS)5-human_IL15(single-chain)_Fc(216)_IgG1_pI(-)_Isosteric_A_C220S/PVA_/S267K/L368D/K370S (SEQ ID NOS 573-576)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVNVISDLKKIEDLIQSMHIDATLYTESDVHPSCKVTAMKCFLLELQVISLESGDASIHDTVENLIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain3—1C11[PD-1]_L3(SEQ ID NOS 577-581)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 68B

<u>XENP024535human_IL15Ra(sushi)_(GGGGS)5-human_IL15(N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q</u>

Chain 1 - 1C11[PD-1]_H3_ IgG1_PVA_/S267K/S364K/E357Q (SEQ ID NOS 582-586)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain2-human_IL15Ra(sushi)_(GGGGS)5-human_IL15(N65D;single-chain)_ Fc(216)_IgG1_pI(-)_Isosteric_A_C220S/PVA_/S267K/L368D/K370S (SEQ ID NOS 587-590)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVNVISDLKKIEDLIQSMHIDATLYTESDVHPSCKVTAMKCFLLELQVISLESGDASIHDTVEDLIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain3-1C11[PD-1]_L3 (SEQ ID NOS 591-595)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC <u>XENP024536human_IL15Ra(sushi)_(GGGGS)5-human_IL15(Q108E;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q</u>

Chain1-1C11[PD-1]_H3_ IgG1_PVA_/S267K/S364K/E357Q (SEQ ID NOS 596-600)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain2-human_IL15Ra(sushi)_(GGGGS)5-human_IL15(Q108E;single-chain)_ Fc(216)_IgG1_pI(-)_Isosteric_A_C220S/PVA_/S267K/L368D/K370S (SEQ ID NOS 601-604)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVNVISDLKKIEDLIQSMHIDATLYTESDVHPSCKVTAMKCFLLELQVISLESGDASIHDTVENLIIANNSLSSNGNVTESGCKECEELEEK
NIKEFLQSFVHIVEMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain3-1C11[PD-1]_L3 (SEQ ID NOS 605-609)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 68C

<u>XENP025850human_IL15Ra(sushi)_(GGGGS)5-human_IL15(N4D/N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q</u>

Chain 1 - 1C11[PD-1]_H3L3_ IgG1_PVA_/S267K/S364K/E357Q (SEQ ID NOS 610-614)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain2-human_IL15Ra(sushi)_(GGGGS)5-human_IL15(N4D/N65D;single-chain)_ Fc(216)_IgG1_pI(-)_Isosteric_A_C220S/PVA_/S267K/L368D/K370S (SEQ ID NOS 615-618)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVDVISDLKKIEDLIQSMHIDATLYTESDVHPSCKVTAMKCFLLELQVISLESGDASIHDTVEDLIIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain3-1C11[PD-1]_L3 (SEQ ID NOS 619-623)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC <u>XENP025937human_IL15Ra(sushi)_(GGGGS)5-human_IL15(N4D/N65D;single-chain)-1C11[PD-1]_H3L3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S</u>

Chain 1 - 1C11[PD-1]_H3_ IgG1_PVA_/S267K/S364K/E357Q/M428L/N434S (SEQ ID NOS 624-628)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK

Chain2-human_IL15Ra(sushi)_(GGGGS)5-human_IL15(N4D/N65D;single-chain)_ Fc(216)_IgG1_pI(-)_Isosteric_A_C220S/PVA_/S267K/L368D/K370S/M428L/N434S (SEQ ID NOS 629-632)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVDVISDLKKIEDLIQSMHIDATLYTESDVHPSCKVTAMKCFLLELQVISLESGDASIHDTVEDLIIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain3-1C11[PD-1]_L3 (SEQ ID NOS 633-637)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 69

XENP022112 1G6_H1.278_L1.188_[PD-1]_Fab-IL15(non-covalent)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q Chain 1 – IL-15 (SEQ ID NO: 638)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS Chain2–1G6_H1.278[PD-1]_IgG1_pI(-)_Isosteric_A_C220S/PVA_/S267K/L368D/K370S (SEQ ID NOS 639-643)
EVQLVESGGGLVKPGGSLRLSCVASGFTFSNYWMNWVRQAPGKGLEWVAEIRLYSNNYATHYAESVKGRFTISRDDSKSTLYLQMNNLKTEDT
GVYYCTRYYGNYGGYFDVWGQGTLVTVSS/ASTKGPSVFPLAPSSKSTSGGTAALGCLVKDYFPEPVTVSWNSGALTSGVHTFPAVLQSSGLY
SLSSVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNHYTQKSLSLSPGK Chain3-human_IL15Ra(Sushi)_Fc(216)_IgG1_C220S/PVA_/S267K/S364K/E357Q (SEQ ID NOS 644-646)
ITCPPPMSVEHADIWVKSYSLYSRERYICNSGFKRKAGTSSLTECVLNKATNVAHWTTPSLKCIR/EPKSSDKTHTCPPCPAPPVAGPSVFLF
PPKPKDTLMISRTPEVTCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK Chain4–1G6_L1.188[PD-1](SEQ ID NOS 647-651)
EIVMTQSPATLSVSPGERVTLTCRASQSVGNDVAWYQQKPGQSPRLLINYASHRYTGVPDRFTGSGYGTEFTLTISSVQSEDFAVYFC**QQDFS
SPRT**FGGGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 70

XENP022641 1G6_H1.278_L1.188_[PD-1]_Fab-IL15(E87C)-human_IL15Ra(Sushi-D96/C97)_Fc(216)_IgG1_pI(-)_Isosteric_A_C220S/PVA_/S267K/L368D/K370S-Fc(216)_IgG1_C220S/PVA_/S267K/S364K/E357Q Chain 1 – IL-15(E87C) (SEQ ID NO: 652)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS Chain2–1G6_H1.278_IgG1_pI(-)_Isosteric_A_C220S/PVA_/S267K/L368D/K370S (SEQ ID NOS 653-657)
EVQLVESGGGLVKPGGSLRLSCVASGFTFSNYWMNWVRQAPGKGLEWVAEIRLYSNNYATHYAESVKGRFTISRDDSKSTLYLQMNNLKTEDT
GVYYCTRYYGNYGGYFDVWGQGTLVTVSS/ASTKGPSVFPLAPSSKSTSGGTAALGCLVKDYFPEPVTVSWNSGALTSGVHTFPAVLQSSGLY
SLSSVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNHYTQKSLSLSPGK Chain3-human_IL15Ra(Sushi-D96/C97)_Fc(216)_IgG1_C220S/PVA_/S267K/S364K/E357Q (SEQ ID NOS 658-660)
ITCPPPMSVEHADIWVKSYSLYSRERYICNSGFKRKAGTSSLTECVLNKATNVAHWTTPSLKCIRDC/EPKSSDKTHTCPPCPAPPVAGPSVF
LFPPKPKDTLMISRTPEVTCVVVDVKHEDPEVKFNWYVDGVEVHNAKTKPREEQYNSTYRVVSVLTVLHQDWLNGKEYKCKVSNKALPAPIEK
TISKAKGQPREPQVYTLPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK Chain4–1G6_L1.188[PD-1](SEQ ID NOS 661-665)
EIVMTQSPATLSVSPGERVTLTCRASQSVGNDVAWYQQKPGQSPRLLINYASHRYTGVPDRFTGSGYGTEFTLTISSVQSEDFAVYFC**QQDFS
SPRT**FGGGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 71A

<u>1C11[PD-1]_H3L3_H1L1_IgG1_pI(-</u>
<u>)_Isosteric_A_C220S/PVA_/S267K/L368D/K370S_(GGGGS)2_IL15Ra(sushi)_(GGGGS)5-IL15(N4D/N65D)</u>

Chain 1 – 1C11[PD-1]_H3_ IgG1_pI(-
)_Isosteric_A_PVA_/S267K/L368D/K370S_(GGGGS)2_IL15Ra(sushi)_(GGGGS)5-IL15(N4D/N65D) (SEQ ID NOS 666-672)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSDTKVDKKVEPKSCDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSP/<u>GGGGSGGGGS</u>/ITCPPPM
SVEHADIWVKSYSLYSRERYICNSGFKRKAGTSSLTECVLNKATNVAHWTTPSLKCIR/<u>GGGGSGGGGSGGGGSGGGGSGGGGS</u>/NWVDVIS
DLKKIEDLIQSMHIDATLYTESDVHPSCKVTAMKCFLLELQVISLESGDASIHDTVEDLIILANNSLSSNGNVTESG
CKECEELEEKNIKEFLQSFVHIVQMFINTS Chain 2 - 1C11[PD-1]_H3_ IgG1_ PVA_/S267K/S364K/E357Q (SEQ ID NOS 673-677)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain 3 – 1C11[PD-1]_L3 (SEQ ID NOS 678-682)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC <u>1C11[PD-1]_H3L3_IgG1_pI(-)_Isosteric_A_PVA_/S267K/L368D/K370S_(GGGGS)5_IL15Ra(Sushi)_IL15(single-</u>
<u>chain)_IgG1_pI_ISO(+RR)_/PVA_/S267K/S364K/E357Q</u>

Chain1–1C11[PD-1]_H3_IgG1_pI(-
)_Isosteric_A_PVA_/S267K/L368D/K370S__(GGGGS)5_IL15Ra(Sushi)_IL15(single-chain) (SEQ ID NOS 683-689)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSDTKVDKKVEPKSCDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSPGK/<u>GGGGSGGGGS</u>/ITCPPP
MSVEHADIWVKSYSLYSRERYICNSGFKRKAGTSSLTECVLNKATNVAHWTTPSLKCIR/<u>GGGGSGGGGSGGGGSGGGGSGGGGS</u>/NWVNVIS
DLKKIEDLIQSMHIDATLYTESDVHPSCKVTAMKCFLLELQVISLESGDASIHDTVENLIILANNSLSSNGNVTESGCKECEELEEKNIKEFL
QSFVHIVQMFINTS Chain2-1C11[PD-1]_H3_IgG1_pI_ISO(+RR)_/PVA_/S267K/S364K/E357Q (SEQ ID NOS 690-694)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTKTYTCNVNHKPSNTKVDKKVERKSCDKTHTCPRCPAPPVAGPSVFLFPPKPKDTLMISRTPEVTCVVVDVKHEDPEVKFKWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain3–1C11[PD-1]_L3 (SEQ ID NOS 695-699)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 71B

1C11[PD-1]_H3L3_IgG1_pI(-
)_Isosteric_A_PVA_/S267K/L368D/K370S_IgG1_pI_ISO(+RR)_/PVA_/S267K/S364K/E357Q_(GGGGS)5_IL15Ra(Sus
hi)_IL15(single-chain)

Chain1–1C11[PD-1]_H3_IgG1_pI(-)_Isosteric_A_PVA_/S267K/L368D/K370S (SEQ ID NOS 700-704)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSDTKVDKKVEPKSCDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSPGK Chain2–1C11[PD-1]_H3_IgG1_pI_ISO(+RR)_/PVA_/S267K/S364K/E357Q_(GGGGS)5_IL15Ra(Sushi)_IL15(single-
chain) (SEQ ID NOS 705-711)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTKTYTCNVNHKPSNTKVDKKVERKSCDKTHTCPRCPAPPVAGPSVFLFPPKPKDTLMISRTPEVTCVVVDVKHEDPEVKFKWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK/<u>GGGGSGGGGS</u>/ITCPPP
MSVEHADIWVKSYSLYSRERYICNSGFKRKAGTSSLTECVLNKATNVAHWTTPSLKCIR/<u>GGGGSGGGGSGGGGSGGGGSGGGGS</u>/NWVNVIS
DLKKIEDLIQSMHIDATLYTESDVHPSCKVTAMKCFLLELQVISLESGDASIHDTVENLIILANNSLSSNGNVTESGCKECEELEEKNIKEFL
QSFVHIVQMFINTS Chain3–1C11[PD-1]_L3 (SEQ ID NOS 712-716)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 72

XENP022642Nivolumab_H0L0_IgG1_pI(-
)_Isosteric_A_PVA_/S267K/L368D/K370S_(GGGGS)2_IL15Ra(Sushi)_IL15(non-
covalent)_IgG1_pI_ISO(+RR)_/PVA_/S267K/S364K/E357Q

Chain 1 – IL-15 (SEQ ID NO: 717)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

Chain2−Nivolumab_H0_IgG1_pI(-)_Isosteric_A_PVA_/S267K/L368D/K370S__(GGGGS)2_IL15Ra(Sushi) (SEQ ID NOS 718-723)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK/GGGGSGGGGS/ITCPPPMSVE
HADIWVKSYSLYSRERYICNSGFKRKAGTSSLTECVLNKATNVAHWTTPSLKCIR

Chain3-Nivolumab_H0_IgG1_pI_ISO(+RR)_/PVA_/S267K/S364K/E357Q (SEQ ID NOS 724-728)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK

Chain4−Nivolumab_L0(SEQ ID NOS 729-733)
EIVLTQSPATLSLSPGERATLSCRASQSVSSYLAWYQQKPGQAPRLLIYDASNRATGIPARFSGSGSGTDFTLTISSLEPEDFAVYYC**QQSSN
WPRT**FGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC XENP022643Nivolumab_H0L0_IgG1_pI(-
)_Isosteric_A_PVA_/S267K/L368D/K370S_IgG1_pI_ISO(+RR)_/PVA_/S267K/S364K/E357Q_(GGGGS)2_IL15Ra(Sus
hi)_IL15(non-covalent)

Chain 1−IL-15(SEQ ID NO: 734)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

Chain2−Nivolumab_H0_IgG1_pI(-)_Isosteric_A_PVA_/S267K/L368D/K370S (SEQ ID NOS 735-739)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK

Chain3−Nivolumab_H0_IgG1_pI_ISO(+RR)_/PVA_/S267K/S364K/E357Q_(GGGGS)2_IL15Ra(Sushi) (SEQ ID NOS 740-745)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK/GGGGSGGGGS/ITCPPPMSVE
HADIWVKSYSLYSRERYICNSGFKRKAGTSSLTECVLNKATNVAHWTTPSLKCIR

Chain4−Nivolumab_L0(SEQ ID NOS 746-750)
EIVLTQSPATLSLSPGERATLSCRASQSVSSYLAWYQQKPGQAPRLLIYDASNRATGIPARFSGSGSGTDFTLTISSLEPEDFAVYYC**QQSSN
WPRT**FGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 73

XENP022644Nivolumab_H0L0_IgG1_pI(-)_Isosteric_A_PVA_/S267K/L368D/K370S_(GGGGS)2_IL15Ra(Sushi-D96/C97)_IL15(E87C)_IgG1_pI_ISO(+RR)_/PVA_/S267K/S364K/E357Q

Chain 1 – IL-15(E87C) (SEQ ID NO: 751)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS

Chain2-Nivolumab_H0_IgG1_pI(-)_Isosteric_A_PVA_/S267K/L368D/K370S_(GGGGS)2_IL15Ra(Sushi-D96/C97) (SEQ ID NOS 752-757)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK/<u>GGGGSGGGGS</u>/ITCPPPMSVE
HADIWVKSYSLYSRERYICNSGFKRKAGTSSLTECVLNKATNVAHWTTPSLKCIRDC

Chain3-Nivolumab_H0_IgG1_pI_ISO(+RR)_/PVA_/S267K/S364K/E357Q (SEQ ID NOS 758-762)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK

Chain4–Nivolumab_L0 (SEQ ID NOS 763-767)
EIVLTQSPATLSLSPGERATLSCRASQSVSSYLAWYQQKPGQAPRLLIYDASNRATGIPARFSGSGSGTDFTLTISSLEPEDFAVYYC**QQSSN
WPRT**FGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC XENP022645Nivolumab_H0L0_IgG1_pI(-)_Isosteric_A_PVA_/S267K/L368D/K370S_IgG1_pI_ISO(+RR)_/PVA_/S267K/S364K/E357Q_(GGGGS)2_IL15Ra(Sushi-D96/C97)_IL15(E87C)

Chain 1 – IL-15(E87C) (SEQ ID NO: 768)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS

Chain2-Nivolumab_H0_IgG1_pI(-)_Isosteric_A_PVA_/S267K/L368D/K370S (SEQ ID NOS 769-773)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK

Chain3-Nivolumab_H0_IgG1_pI_ISO(+RR)_/PVA_/S267K/S364K/E357Q_(GGGGS)2_IL15Ra(Sushi-D96/C97) (SEQ ID NOS 774-779)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK/<u>GGGGSGGGGS</u>/ITCPPPMSVE
HADIWVKSYSLYSRERYICNSGFKRKAGTSSLTECVLNKATNVAHWTTPSLKCIRDC

Chain4–Nivolumab_L0 (SEQ ID NOS 780-784)
EIVLTQSPATLSLSPGERATLSCRASQSVSSYLAWYQQKPGQAPRLLIYDASNRATGIPARFSGSGSGTDFTLTISSLEPEDFAVYYC**QQSSN
WPRT**FGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 74

<u>1C11[PD-1]_H3L3_bivalent_IL15_N4D/N65D_IL15Ra(sushi)_(GGGGS)1_Fc(216)_IgG1_pI(-
)_Isosteric_A_C220S/PVA_/S267K/L368D/K370S_Fc(216)_IgG1_C220S/PVA_/S267K/S364K/E357Q</u>

Chain 1 - 1C11[PD-1]_H3_IL15_N4D/N65D_(GGGGS)1_Fc(216)_IgG1_pI(-
)_Isosteric_A_C220S/PVA_/S267K/L368D/K370S (SEQ ID NOS 785-791)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSC/<u>GGGGSGGGGS</u>/NWVDVISDLKKIEDLIQS
MHIDATLYTESDVHPSCKVTAMKCFLLELQVISLESGDASIHDTVEDLIILANNSLSSNGNVTESGCKECEELEEKN
IKEFLQSFVHIVQMFINTS/<u>GGGGS</u>/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPR
EPQVYTLPPSREEMTKNQVSLTCDVSGFYPSDIAVEWESDGQPENNYKTTPPVLDSDGSFFLYSKLTVDKSRWEQGD
VFSCSVMHEALHNHYTQKSLSLSPGK Chain 2 - 1C11[PD-1]_H3_IL15Ra(sushi)_(GGGGS)1_Fc(216)_IgG1_C220S/PVA_/S267K/S364K/E357Q (SEQ ID NOS 792-798)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSC/<u>GGGGSGGGGS</u>/ITCPPPMSVEHADIWVKS
YSLYSRERYICNSGFKRKAGTSSLTECVLNKATNVAHWTTPSLKCIR/<u>GGGGS</u>/EPKSSDKTHTCPPCPAPPVAGPS
VFLFPPKPKDTLMISRTPEVTCVVVDVKHEDPEVKFNWYVDGVEVHNAKTKPREEQYNSTYRVVSVLTVLHQDWLNG
KEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK Chain 3 - 1C11[PD-1]_L3 (SEQ ID NOS 799-803)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 75

1C11[PD-1]_H3L3_Fab-IL15Ra(sushi)_(GGGGS)5-IL15(N4D/N65D)-1C11[PD-1]_H3L3_Fab_Fc(216)_IgG1_pI(-)_Isosteric_A_C220S/PVA_/S267K/L368D/K370S_IgG1_C220S/PVA_/S267K/S364K/E357Q

Chain 1 - 1C11[PD-1]_H3_IL15Ra(sushi)_(GGGGS)5-IL15(N4D/N65D)_IgG1_pI(-)_Isosteric_A_C220S/PVA_/S267K/L368D/K370S (SEQ ID NOS 804-811)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSC/<u>GGGGSGGGGS</u>/ITCPPPMSVEHADIWVKS
YSLYSRERYICNSGFKRKAGTSSLTECVLNKATNVAHWTTPSLKCIR/<u>GGGGSGGGGSGGGGSGGGGSGGGGS</u>/NWVD
<u>VISDLKKIEDLIQSMHIDATLYTESDVHPSCKVTAMKCFLLELQVISLESGDASIHDTVEDLIILANNSLSSNGNVTESGCKECEELEEKNIK</u>
<u>EFLQSFVHIVQMFINTS</u>/EPKSSDKTHTCPPCPAPPVAGPSVFLFPPKPKDTLMISRTPEVTCVVVDVKHEDPEVKFNWY
VDGVEVHNAKTKPREEEYNSTYRVVSVLTVLHQDWLNGKEYKCKVSNKALPAPIEKTISKAKGQPREPQVYTLPPSR
EEMTKNQVSLTCDVSGFYPSDIAVEWESDGQPENNYKTTPPVLDSDGSFFLYSKLTVDKSRWEQGDVFSCSVMHEAL
HNHYTQKSLSLSPGK

Chain 2 - 1C11[PD-1]_H3_IgG1_C220S/PVA_/S267K/S364K/E357Q (SEQ ID NOS 812-816)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPPVAGPSVFLFPPKPKDTL
MISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Chain 3 – 1C11[PD-1]_L3 (SEQ ID NOS 817-821)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC pI(MW) = 7.32 (101.0 kDa)
Protein A yield = 33.6 mg/L

Figure 85A

XENP021575 1C11[PD-1]_H0L0_IgG1_PVA_/S267K Heavy Chain (SEQ ID NOS 822-826)
QIQLVQSGPELKKPGETVKISCRASGYTFTHYGMNWVKQAPGKGLKWMGWINTYTGEPTYADDFKGRFAFSLETSASTAYLQINNLKNEDTAT
YFCARDYYGSSPYWGQGTTLTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

XENP021575 1C11[PD-1]_H0L0_IgG1_PVA_/S267K Light Chain (SEQ ID NOS 827-831)
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYC
FQGSHVPNTFGGGTKLEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

>XENP022543 1C11[PD-1]_H1L1_IgG1_PVA_/S267K Heavy Chain (SEQ ID NOS 832-836)
QIQLVQSGAEVKKPGASVKVSCKASGYTFTHYGMNWVRQAPGQGLEWMGWINTYTGEPTYADKFQGRVTMTLDTSTS
TAYMELSSLRSEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022543 1C11[PD-1]_H1L1_IgG1_PVA_/S267K Light Chain (SEQ ID NOS 837-841)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022544 1C11[PD-1]_H2L1_IgG1_PVA_/S267K Heavy Chain (SEQ ID NOS 842-846)
EIQLLESGGGLVQPGGSLRLSCAASGYTFTHYGMNWVRQAPGKGLEWVSWINTYTGEPTYADSVKGRFTISLDTSKS
TAYLQMNSLRAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022544 1C11[PD-1]_H2L1_IgG1_PVA_/S267K Light Chain (SEQ ID NOS 847-851)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022545 1C11[PD-1]_H3L1_IgG1_PVA_/S267K Heavy Chain (SEQ ID NOS 852-856)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022545 1C11[PD-1]_H3L1_IgG1_PVA_/S267K Light Chain (SEQ ID NOS 857-861)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 85B

>XENP022546 1C11[PD-1]_H4L1_IgG1_PVA_/S267K Heavy Chain (SEQ ID NOS 862-866)
EVQLLESGGGLVQPGGSLRLSCAASGYTFTHYGMNWVRQAPGKGLEWVSWINTYTGEPTYADSVKGRFTISLDTSKS
TAYLQMNSLRAEDTAVYYCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK >XENP022546 1C11[PD-1]_H4L1_IgG1_PVA_/S267K Light Chain (SEQ ID NOS 867-871)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP022547 1C11[PD-1]_H1L2_IgG1_PVA_/S267K Heavy Chain (SEQ ID NOS 872-876)
QIQLVQSGAEVKKPGASVKVSCKASGYTFTHYGMNWVRQAPGQGLEWMGWINTYTGEPTYADKFQGRVTMTLDTSTS
TAYMELSSLRSEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK >XENP022547 1C11[PD-1]_H1L2_IgG1_PVA_/S267K Light Chain (SEQ ID NOS 877-881)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP022548 1C11[PD-1]_H2L2_IgG1_PVA_/S267K Heavy Chain (SEQ ID NOS 882-886)
EIQLLESGGGLVQPGGSLRLSCAASGYTFTHYGMNWVRQAPGKGLEWVSWINTYTGEPTYADSVKGRFTISLDTSKS
TAYLQMNSLRAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK >XENP022548 1C11[PD-1]_H2L2_IgG1_PVA_/S267K Light Chain (SEQ ID NOS 887-891)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP022549 1C11[PD-1]_H3L2_IgG1_PVA_/S267K Heavy Chain (SEQ ID NOS 892-896)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK >XENP022549 1C11[PD-1]_H3L2_IgG1_PVA_/S267K Light Chain (SEQ ID NOS 897-901)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 85C

>XENP022550 1C11[PD-1]_H4L2_IgG1_PVA_/S267K Heavy Chain (SEQ ID NOS 902-906)
EVQLLESGGGLVQPGGSLRLSCAASGYTFTHYGMNWVRQAPGKGLEWVSWINTYTGEPTYADSVKGRFTISLDTSKS
TAYLQMNSLRAEDTAVYYCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022550 1C11[PD-1]_H4L2_IgG1_PVA_/S267K Light Chain (SEQ ID NOS 907-911)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022551 1C11[PD-1]_H1L3_IgG1_PVA_/S267K Heavy Chain (SEQ ID NOS 912-916)
QIQLVQSGAEVKKPGASVKVSCKASGYTFTHYGMNWVRQAPGQGLEWMGWINTYTGEPTYADKFQGRVTMTLDTSTS
TAYMELSSLRSEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022551 1C11[PD-1]_H1L3_IgG1_PVA_/S267K Light Chain (SEQ ID NOS 917-921)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022552 1C11[PD-1]_H2L3_IgG1_PVA_/S267K Heavy Chain (SEQ ID NOS 922-926)
EIQLLESGGGLVQPGGSLRLSCAASGYTFTHYGMNWVRQAPGKGLEWVSWINTYTGEPTYADSVKGRFTISLDTSKS
TAYLQMNSLRAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022552 1C11[PD-1]_H2L3_IgG1_PVA_/S267K Light Chain (SEQ ID NOS 927-931)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022553 1C11[PD-1]_H3L3_IgG1_PVA_/S267K Heavy Chain (SEQ ID NOS 932-936)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022553 1C11[PD-1]_H3L3_IgG1_PVA_/S267K Light Chain (SEQ ID NOS 937-941)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 85D

>XENP022554 1C11[PD-1]_H4L3_IgG1_PVA_/S267K Heavy Chain (SEQ ID NOS 942-946)
EVQLLESGGGLVQPGGSLRLSCAASGYTFTHYGMNWVRQAPGKGLEWVSWINTYTGEPTYADSVKGRFTISLDTSKS
TAYLQMNSLRAEDTAVYYCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022554 1C11[PD-1]_H4L3_IgG1_PVA_/S267K Light Chain (SEQ ID NOS 947-951)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

XENP021480 human_IL15Ra(sushi)_(GGGGS)6-human_IL15(single-chain)-
1G6_L1.194_H1.279_scFv(GKPGS)4_IgG1_pI(-)_Isosteric_A_C220S/PVA_/S267K/L368D/K370S-
Fc(216)_IgG1_C220S/PVA_/S267K/S364K/E357Q

Chain 1 - human_IL15Ra(sushi)_(GGGGS)6-human_IL15(single-chain)_IgG1_pI(-
)_Isosteric_A_C220S/PVA_/S267K/L368D/K370S (SEQ ID NOS 952-955)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGSGG</u>
<u>GGS</u>/NWVNVISDLKKIEDLIQSMHIDATLYTESDVHPSCKVTAMKCFLLELQVISLESGDASIHDTVENLIILANNSLSSNGNVTESGCKECE
ELEEKNIKEFLQSFVHIVQMFINTS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK

Chain2 -1G6_L1.194_H1.279_scFv(GKPGS)4_IgG1_C220S/PVA_/S267K/S364K/E357Q (SEQ ID NOS 956-965)
EIVLTQSPATLSASPGERVTLTCRASQSVGNDVAWYQQKPGQAPRLLINYASHRYTGVPDRFTGSGYGTEFTLTISSVQSEDFGVYYCQQDFS
SPRTFGGGTKVEIK/<u>GKPGSGKPGSGKPGSGKPGS</u>/EVQLVESGGGLVKPGGSLRLSCVASGFTFSNYWMNWVRQAPGKGLEWVAEIRLYSNN
YATHYAESVKGRFTISRDDSKSTLYLQMNNLKTEDTGVYYCTRYYGNYGGYFDVWGRGTLVTVSS/EPKSSDKTHTCPPCPAPPVAGPSVFLF
PPKPKDTLMISRTPEVTCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

1G6_L1.194_H1.279_scFv(GKPGS)4-human_IL15Ra(sushi)_(GGGGS)6-human_IL15(non-
covalent)_Fc(216)_IgG1_pI(-)_Isosteric_A_C220S/PVA_/S267K/L368D/K370S-
Fc(216)_IgG1_C220S/PVA_/S267K/S364K/E357Q

Chain 1 – 1G6_L1.194_H1.279_scFv(GKPGS)4_ Fc(216)_IgG1_pI(-)_Isosteric_A_C220S/PVA_/S267K/L368D/K370S
(SEQ ID NOS 966-975)
EIVLTQSPATLSASPGERVTLTCRASQSVGNDVAWYQQKPGQAPRLLINYASHRYTGVPDRFTGSGYGTEFTLTISSVQSEDFGVYYCQQDFS
SPRTFGGGTKVEIK/<u>GKPGSGKPGSGKPGSGKPGS</u>/EVQLVESGGGLVKPGGSLRLSCVASGFTFSNYWMNWVRQAPGKGLEWVAEIRLYSNN
YATHYAESVKGRFTISRDDSKSTLYLQMNNLKTEDTGVYYCTRYYGNYGGYFDVWGRGTLVTVSS/EPKSSDKTHTCPPCPAPPVAGPSVFLF
PPKPKDTLMISRTPEVTCVVVDVKHEDPEVKFNWYVDGVEVHNAKTKPREEEYNSTYRVVSVLTVLHQDWLNGKEYKCKVSNKALPAPIEKTI
SKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK

Chain2-human_IL15Ra(sushi)_(GGGGS)6_ Fc(216)_IgG1_C220S/PVA_/S267K/S364K/E357Q (SEQ ID NOS 976-978)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGSGG</u>
<u>GGS</u>/EPKSSDKTHTCPPCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK

Figure 85E

Chain3—IL-15(SEQ ID NO: 979)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

**1G6_L1.194_H1.279_scFv(GKPGS)4-human_IL15Ra(sushi-D96/C97/A98)-human_IL15(E87C)_Fc(216)_IgG1_pI(-
)_Isosteric_A_C220S/PVA_/S267K/L368D/K370S-Fc(216)_IgG1_C220S/PVA_/S267K/S364K/E357Q**

**Chain 1 – 1G6_L1.194_H1.279_scFv(GKPGS)4_Fc(216)_IgG1_pI(-)_Isosteric_A_C220S/PVA_/S267K/L368D/K370S
(SEQ ID NOS 980-989)**
EIVLTQSPATLSASPGERVTLTCRASQSVGNDVAWYQQKPGQAPRLLINYASHRYTGVPDRFTGSGYGTEFTLTISSVQSEDFGVYYC**QQDFS
SPRTFGGGTKVEIK/GKPGSGKPGSGKPGSGKPGS/EVQLVESGGGLVKPGGSLRLSCVASGFTFSNYWMNWVRQAPGKGLEWVAEIRLYSNN
YATHYAESVKGRFTISRDDSKSTLYLQMNNLKTEDTGVYYCTRYYGNYGGYFDV**WGRGTLVTVSS/EPKSSDKTHTCPPCPAPPVAGPSVFLF
PPKPKDTLMISRTPEVTCVVVDVKHEDPEVKFNWYVDGVEVHNAKTKPREEEYNSTYRVVSVLTVLHQDWLNGKEYKCKVSNKALPAPIEKTI
SKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK

**Chain2-human_IL15Ra(sushi-D96/C97/A98)_Fc(216)_IgG1_C220S/PVA_/S267K/S364K/E357Q (SEQ ID NOS 990-
992)**
ITCPPPMSVEHADIWVKSYSLYSRERYICNSGFKRKAGTSSLTECVLNKATNVAHWTTPSLKCIRDCA/EPKSSDKTHTCPPCPAPPVAGPSV
FLFPPKPKDTLMISRTPEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain3—IL-15(E87C)(SEQ ID NO: 993)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS

**XENP022022human_IL15Ra(sushi)_(GGGGS)6-human_IL15(single-chain)-1G6_H1.278_L1.188_[PD-
1]_Fab_IgG1_pI(-)_Isosteric_A_/PVA_/S267K/L368D/K370S-Fc(216)_IgG1_C220S/PVA_/S267K/S364K/E357Q**

**Chain 1 - human_IL15Ra(sushi)_(GGGGS)6-human_IL15(single-chain)_IgG1_pI(-
)_Isosteric_A_/PVA_/S267K/L368D/K370S (SEQ ID NOS 994-997)**
ITCPPPMSVEHADIWVKSYSLYSRERYICNSGFKRKAGTSSLTECVLNKATNVAHWTTPSLKCIR/GGGGSGGGGSGGGGSGGGGSGGGGSGG
GGS/NWVNVISDLKKIEDLIQSMHIDATLYTESDVHPSCKVTAMKCFLLELQVISLESGDASIHDTVENLIILANNSLSSNGNVTESGCKECE
ELEEKNIKEFLQSFVHIVQMFINTS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK

Chain2-1G6_H1.278_[PD-1]_IgG1_C220S/PVA_/S267K/S364K/E357Q (SEQ ID NOS 998-1002)
EVQLVESGGGLVKPGGSLRLSCVASGFTFSNYWMNWVRQAPGKGLEWVAEIRLYSNNYATHYAESVKGRFTISRDDSKSTLYLQMNNLKTEDT
GVYYCTRYYGNYGGYFDVWGQGTLVTVSS/ASTKGPSVFPLAPSSKSTSGGTAALGCLVKDYFPEPVTVSWNSGALTSGVHTFPAVLQSSGLY
SLSSVVTVPSSSLGTQTYICNVNHKPSDTKVDKKVEPKSSDKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLSLSPGK

Chain3-1G6_L1.188[PD-1] (SEQ ID NOS 1003-1007)
EIVMTQSPATLSVSPGERVTLTCRASQSVGNDVAWYQQKPGQSPRLLINYASHRYTGVPDRFTGSGYGTEFTLTISSVQSEDFAVYFC**QQDFS
SPRT**FGGGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 85F

XENP025849human_IL15Ra(sushi)_(GGGGS)5-human_IL15(single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q Chain 1 - 1C11[PD-1]_H3_ IgG1_PVA_/S267K/S364K/E357Q (SEQ ID NOS 1008-1012)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain2- human_IL15Ra(sushi)_(GGGGS)5-human_IL15(single-chain)_Fc(216)_IgG1_pI(-)_Isosteric_A_C220S/PVA_/S267K/L368D/K370S (SEQ ID NOS 1013-1016)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVNVISDLKKIEDLIQSMHIDATLYTESDVHPSCKVTAMKCFLLELQVISLESGDASIHDTVENLIIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain3–1C11[PD-1]_L3(SEQ ID NOS 1017-1021)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC XENP024535human_IL15Ra(sushi)_(GGGGS)5-human_IL15(N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q Chain 1 - 1C11[PD-1]_H3_ IgG1_PVA_/S267K/S364K/E357Q (SEQ ID NOS 1022-1026)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain2-human_IL15Ra(sushi)_(GGGGS)5-human_IL15(N65D;single-chain)_Fc(216)_IgG1_pI(-)_Isosteric_A_C220S/PVA_/S267K/L368D/K370S (SEQ ID NOS 1027-1030)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVNVISDLKKIEDLIQSMHIDATLYTESDVHPSCKVTAMKCFLLELQVISLESGDASIHDTVEDLIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain3-1C11[PD-1]_L3 (SEQ ID NOS 1031-1035)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 85G

<u>XENP024536human_IL15Ra(sushi)_(GGGGS)5-human_IL15(Q108E;single-chain)-1C11[PD-
1]_H3L3_IgG1_Fc(216)_IgG1_pI(-)_Isosteric_A_C220S/PVA_/S267K/L368D/K370S-
IgG1_PVA_/S267K/S364K/E357Q</u>

Chain1-1C11[PD-1]_H3_IgG1_PVA_/S267K/S364K/E357Q (SEQ ID NOS 1036-1040)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain2-human_IL15Ra(sushi)_(GGGGS)5-human_IL15(Q108E;single-chain)_Fc(216)_IgG1_pI(-
)_Isosteric_A_C220S/PVA_/S267K/L368D/K370S (SEQ ID NOS 1041-1044)
<u>ITCPPPMSVEHADIWVKSYSLYSRERYICNSGFKRKAGTSSLTECVLNKATNVAHWTTPSLKCIR</u>/<u>GGGGSGGGGSGGGGSGGGGSGGGGS</u>/N
WVNVISDLKKIEDLIQSMHIDATLYTESDVHPSCKVTAMKCFLLELQVISLESGDASIHDTVENLIIANNSLSSNGNVTESGCKECEELEEK
NIKEFLQSFVHIVEMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain3-1C11[PD-1]_L3 (SEQ ID NOS 1045-1049)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC <u>XENP025850human_IL15Ra(sushi)_(GGGGS)5-human_IL15(N4D/N65D;single-chain)-1C11[PD-
1]_H3L3_IgG1_Fc(216)_IgG1_pI(-)_Isosteric_A_C220S/PVA_/S267K/L368D/K370S-
IgG1_PVA_/S267K/S364K/E357Q</u>

Chain 1 - 1C11[PD-1]_H3L3_IgG1_PVA_/S267K/S364K/E357Q (SEQ ID NOS 1050-1054)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain2-human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S (SEQ ID NOS 1055-1058)
<u>ITCPPPMSVEHADIWVKSYSLYSRERYICNSGFKRKAGTSSLTECVLNKATNVAHWTTPSLKCIR</u>/<u>GGGGSGGGGSGGGGSGGGGSGGGGS</u>/N
WVDVISDLKKIEDLIQSMHIDATLYTESDVHPSCKVTAMKCFLLELQVISLESGDASIHDTVEDLIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain3-1C11[PD-1]_L3 (SEQ ID NOS 1059-1063)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 85H

<u>XENP025937 human_IL15Ra(sushi)_(GGGGS)5-human_IL15(N4D/N65D;single-chain)-1C11[PD-1]_H3L3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S</u>

Chain 1 - 1C11[PD-1]_H3_IgG1_PVA_/S267K/S364K/E357Q/M428L/N434S (SEQ ID NOS 1064-1068)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK

Chain2-human_IL15Ra(sushi)_(GGGGS)5-human_IL15(N4D/N65D;single-chain)_ Fc(216)_IgG1_pI(-)_Isosteric_A_C220S/PVA_/S267K/L368D/K370S/M428L/N434S (SEQ ID NOS 1069-1072)
ITCPPPMSVEHADIWVKSYSLYSRERYICNSGFKRKAGTSSLTECVLNKATNVAHWTTPSLKCIR/<u>GGGGSGGGGSGGGGSGGGGSGGGGS</u>/N
WVDVISDLKKIEDLIQSMHIDATLYTESDVHPSCKVTAMKCFLLELQVISLESGDASIHDTVEDLIIIANNSLSSNGNVTESGCKECEELEEK
NIKEFLQSFVHIVQMFINTS/EPKSSDKTHTCPPCPAPPVAGPSVFLFPPKPKDTLMISRTPEVTCVVVDVKHEDPEVKFNWYVDGVEVHNAK
TKPREEEYNSTYRVVSVLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain3-1C11[PD-1]_L3 (SEQ ID NOS 1073-1077)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC <u>XENP022112 1G6_H1.278_L1.188_[PD-1]_Fab-IL15(non-covalent)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q</u>

Chain 1 – IL-15 (SEQ ID NO: 1078)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

Chain2–1G6_H1.278[PD-1]_IgG1_pI(-)_Isosteric_A_C220S/PVA_/S267K/L368D/K370S (SEQ ID NOS 1079-1083)
EVQLVESGGGLVKPGGSLRLSCVASGFTFSNYWMNWVRQAPGKGLEWVAEIRLYSNNYATHYAESVKGRFTISRDDSKSTLYLQMNNLKTEDT
GVYYCTRYYGNYGGYFDVWGQGTLVTVSS/ASTKGPSVFPLAPSSKSTSGGTAALGCLVKDYFPEPVTVSWNSGALTSGVHTFPAVLQSSGLY
SLSSVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNHYTQKSLSLSPGK

Chain3-human_IL15Ra(Sushi)_Fc(216)_ IgG1_C220S/PVA_/S267K/S364K/E357Q (SEQ ID NOS 1084-1086)
ITCPPPMSVEHADIWVKSYSLYSRERYICNSGFKRKAGTSSLTECVLNKATNVAHWTTPSLKCIR/EPKSSDKTHTCPPCPAPPVAGPSVFLF
PPKPKDTLMISRTPEVTCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain4–1G6_L1.188[PD-1](SEQ ID NOS 1087-1091)
EIVMTQSPATLSVSPGERVTLTCRASQSVGNDVAWYQQKPGQSPRLLINYASHRYTGVPDRFTGSGYGTEFTLTISSVQSEDFAVYFC**QQDFS
SPRT**FGGGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 85I

<u>XENP0226411G6_H1.278_L1.188_[PD-1]_Fab-IL15(E87C)-human_IL15Ra(Sushi-D96/C97)_Fc(216)_IgG1_pI(-)_Isosteric_A_C220S/PVA_/S267K/L368D/K370S-Fc(216)_IgG1_C220S/PVA_/S267K/S364K/E357Q</u>

Chain 1 – IL-15(E87C) (SEQ ID NO: 1092)
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTS

Chain 2 – 1G6_H1.278_ IgG1_pI(-)_Isosteric_A_C220S/PVA_/S267K/L368D/K370S (SEQ ID NOS 1093-1097)
EVQLVESGGGLVKPGGSLRLSCVASGFTFSNYWMNWVRQAPGKGLEWVAEIRLYSNNYATHYAESVKGRFTISRDDSKSTLYLQMNNLKTEDT
GVYYCTRYYGNYGGYFDVWGQGTLVTVSS/ASTKGPSVFPLAPSSKSTSGGTAALGCLVKDYFPEPVTVSWNSGALTSGVHTFPAVLQSSGLY
SLSSVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNHYTQKSLSLSPGK

Chain 3 – human_IL15Ra(Sushi-D96/C97)_Fc(216)_ IgG1_C220S/PVA_/S267K/S364K/E357Q (SEQ ID NOS 1098-1100)
ITCPPPMSVEHADIWVKSYSLYSRERYICNSGFKRKAGTSSLTECVLNKATNVAHWTTPSLKCIRDC/EPKSSDKTHTCPPCPAPPVAGPSVF
LFPPKPKDTLMISRTPEVTCVVVDVKHEDPEVKFNWYVDGVEVHNAKTKPREEQYNSTYRVVSVLTVLHQDWLNGKEYKCKVSNKALPAPIEK
TISKAKGQPREPQVYTLPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 4 – 1G6_L1.188[PD-1] (SEQ ID NOS 1101-1105)
EIVMTQSPATLSVSPGERVTLTCRASQSVGNDVAWYQQKPGQSPRLLINYASHRYTGVPDRFTGSGYGTEFTLTISSVQSEDFAVYFC**QQDFS
SPRT**FGGGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC <u>1C11[PD-1]_H3L3_H1L1_IgG1_pI(-)_Isosteric_A_C220S/PVA_/S267K/L368D/K370S_(GGGGS)2_IL15Ra(sushi)_(GGGGS)5-IL15(N4D/N65D)</u>

Chain 1 – 1C11[PD-1]_H3_ IgG1_pI(-)_Isosteric_A_PVA_/S267K/L368D/K370S_(GGGGS)2_IL15Ra(sushi)_(GGGGS)5-IL15(N4D/N65D) (SEQ ID NOS 1106-1112)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSDTKVDKKVEPKSCDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSP/<u>GGGGSGGGGS</u>/ITCPPPM
SVEHADIWVKSYSLYSRERYICNSGFKRKAGTSSLTECVLNKATNVAHWTTPSLKCIR/<u>GGGGSGGGGSGGGGSGGGGSGGGGS</u>/NWVDVIS
DLKKIEDLIQSMHIDATLYTESDVHPSCKVTAMKCFLLELQVISLESGDASIHDTVEDLIILANNSLSSNGNVTESG
CKECEELEEKNIKEFLQSFVHIVQMFINTS

Chain 2 - 1C11[PD-1]_H3_ IgG1_ PVA_/S267K/S364K/E357Q (SEQ ID NOS 1113-1117)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3 – 1C11[PD-1]_L3 (SEQ ID NOS 1118-1122)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 85J

<u>1C11[PD-1]_H3L3_IgG1_pI(-)_Isosteric_A_PVA_/S267K/L368D/K370S_(GGGGS)5_IL15Ra(Sushi)_IL15(single-chain)_IgG1_pI_ISO(+RR)_/PVA_/S267K/S364K/E357Q</u>

Chain1-1C11[PD-1]_H3_IgG1_pI(-)_Isosteric_A_PVA_/S267K/L368D/K370S__(GGGGS)5_IL15Ra(Sushi)_IL15(single-chain) (SEQ ID NOS 1123-1129)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSDTKVDKKVEPKSCDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSPGK/<u>GGGGSGGGGS</u>/ITCPPP
MSVEHADIWVKSYSLYSRERYICNSGFKRKAGTSSLTECVLNKATNVAHWTTPSLKCIR/<u>GGGGSGGGGSGGGGSGGGGSGGGGS</u>/NWVNVIS
<u>DLKKIEDLIQSMHIDATLYTESDVHPSCKVTAMKCFLLELQVISLESGDASIHDTVENLIIIANNSLSSNGNVTESGCKECEELEEKNIKEFL
QSFVHIVQMFINTS</u>

Chain2-1C11[PD-1]_H3_IgG1_pI_ISO(+RR)_/PVA_/S267K/S364K/E357Q (SEQ ID NOS 1130-1134)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTKTYTCNVNHKPSNTKVDKKVERKSCDKTHTCPRCPAPPVAGPSVFLFPPKPKDTLMISRTPEVTCVVVDVKHEDPEVKFKWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain3-1C11[PD-1]_L3 (SEQ ID NOS 1135-1139)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC <u>1C11[PD-1]_H3L3_IgG1_pI(-)_Isosteric_A_PVA_/S267K/L368D/K370S_IgG1_pI_ISO(+RR)_/PVA_/S267K/S364K/E357Q_(GGGGS)5_IL15Ra(Sushi)_IL15(single-chain)</u>

Chain1-1C11[PD-1]_H3_IgG1_pI(-)_Isosteric_A_PVA_/S267K/L368D/K370S (SEQ ID NOS 1140-1144)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSDTKVDKKVEPKSCDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSPGK Chain2-1C11[PD-1]_H3_IgG1_pI_ISO(+RR)_/PVA_/S267K/S364K/E357Q_(GGGGS)5_IL15Ra(Sushi)_IL15(single-chain) (SEQ ID NOS 1145-1151)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAVLQSSGLYSLSSV
VTVPSSSLGTKTYTCNVNHKPSNTKVDKKVERKSCDKTHTCPRCPAPPVAGPSVFLFPPKPKDTLMISRTPEVTCVVVDVKHEDPEVKFKWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK/<u>GGGGSGGGGS</u>/ITCPPP
MSVEHADIWVKSYSLYSRERYICNSGFKRKAGTSSLTECVLNKATNVAHWTTPSLKCIR/<u>GGGGSGGGGSGGGGSGGGGSGGGGS</u>/NWVNVIS
<u>DLKKIEDLIQSMHIDATLYTESDVHPSCKVTAMKCFLLELQVISLESGDASIHDTVENLIIIANNSLSSNGNVTESGCKECEELEEKNIKEFL
QSFVHIVQMFINTS</u>

Chain3-1C11[PD-1]_L3 (SEQ ID NOS 1152-1156)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

Figure 85K

<u>XENP022642Nivolumab_H0L0_IgG1_pI(-</u>
<u>) Isosteric_A_PVA_/S267K/L368D/K370S_(GGGGS)2_IL15Ra(Sushi)_IL15(non-</u>
<u>covalent)_IgG1_pI_ISO(+RR)_/PVA_/S267K/S364K/E357Q</u>

Chain 1 – IL-15 (SEQ ID NO: 1157)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

Chain2–Nivolumab_H0_IgG1_pI(-)_Isosteric_A_PVA_/S267K/L368D/K370S__(GGGGS)2_IL15Ra(Sushi) (SEQ ID NOS 1158-1163)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK/<u>GGGGSGGGGS</u>/<u>ITCPPPMSVE</u>
<u>HADIWVKSYSLYSRERYICNSGFKRKAGTSSLTECVLNKATNVAHWTTPSLKCIR</u>

Chain3–Nivolumab_H0_IgG1_pI_ISO(+RR)_/PVA_/S267K/S364K/E357Q (SEQ ID NOS 1164-1168)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK

Chain4–Nivolumab_L0(SEQ ID NOS 1169-1173)
EIVLTQSPATLSLSPGERATLSCRASQSVSSYLAWYQQKPGQAPRLLIYDASNRATGIPARFSGSGSGTDFTLTISSLEPEDFAVYYCQQSSN
WPRTFGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC <u>XENP022643Nivolumab_H0L0_IgG1_pI(-</u>
<u>) Isosteric_A_PVA_/S267K/L368D/K370S_IgG1_pI_ISO(+RR)_/PVA_/S267K/S364K/E357Q_(GGGGS)2_IL15Ra(Sus</u>
<u>hi)_IL15(non-covalent)</u>

Chain1–IL-15(SEQ ID NO: 1174)
NWVNVISDLKKIEDLIQSMHIDATLYTESDVHPSCKVTAMKCFLLELQVISLESGDASIHDTVENLIILANNSLSSNGNVTESGCKECEELEE
KNIKEFLQSFVHIVQMFINTS

Chain2–Nivolumab_H0_IgG1_pI(-)_Isosteric_A_PVA_/S267K/L368D/K370S (SEQ ID NOS 1175-1179)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK

Chain3–Nivolumab_H0_IgG1_pI_ISO(+RR)_/PVA_/S267K/S364K/E357Q_(GGGGS)2_IL15Ra(Sushi) (SEQ ID NOS 1180-1185)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK/<u>GGGGSGGGGS</u>/<u>ITCPPPMSVE</u>
<u>HADIWVKSYSLYSRERYICNSGFKRKAGTSSLTECVLNKATNVAHWTTPSLKCIR</u>

Figure 85L

Chain4-Nivolumab_L0(SEQ ID NOS 1186-1190)
EIVLTQSPATLSLSPGERATLSCRASQSVSSYLAWYQQKPGQAPRLLIYDASNRATGIPARFSGSGSGTDFTLTISSLEPEDFAVYYC**QQSSN
WPRT**FGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

**XENP022644Nivolumab_H0L0_IgG1_pI(-)_Isosteric_A_PVA_/S267K/L368D/K370S_(GGGGS)2_IL15Ra(Sushi-
D96/C97)_IL15(E87C)_IgG1_pI_ISO(+RR)_/PVA_/S267K/S364K/E357Q**

Chain 1 – IL-15(E87C) (SEQ ID NO: 1191)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS

**Chain2-Nivolumab_H0_IgG1_pI(-)_Isosteric_A_PVA_/S267K/L368D/K370S_(GGGGS)2_IL15Ra(Sushi-D96/C97)
(SEQ ID NOS 1192-1197)**
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK/GGGGSGGGGS/ITCPPPMSVE
HADIWVKSYSLYSRERYICNSGFKRKAGTSSLTECVLNKATNVAHWTTPSLKCIRDC

Chain3-Nivolumab_H0_IgG1_pI_ISO(+RR)_/PVA_/S267K/S364K/E357Q (SEQ ID NOS 1198-1202)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK

Chain4-Nivolumab_L0(SEQ ID NOS 1203-1207)
EIVLTQSPATLSLSPGERATLSCRASQSVSSYLAWYQQKPGQAPRLLIYDASNRATGIPARFSGSGSGTDFTLTISSLEPEDFAVYYC**QQSSN
WPRT**FGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC

**XENP022645Nivolumab_H0L0_IgG1_pI(-
)_Isosteric_A_PVA_/S267K/L368D/K370S_IgG1_pI_ISO(+RR)_/PVA_/S267K/S364K/E357Q_(GGGGS)2_IL15Ra(Sus
hi-D96/C97)_IL15(E87C)**

Chain 1 – IL-15(E87C) (SEQ ID NO: 1208)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS

Chain2-Nivolumab_H0_IgG1_pI(-)_Isosteric_A_PVA_/S267K/L368D/K370S (SEQ ID NOS 1209-1213)
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTQTYICNVNHKPSDTKVDKKVEPKSCDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTKNQVSLTCDVSGFYPSD
IAVEWESDGQPENNYKTTPPVLDSDGSFFLYSKLTVDKSRWEQGDVFSCSVMHEALHNHYTQKSLSLSPGK

**Chain3-Nivolumab_H0_IgG1_pI_ISO(+RR)_/PVA_/S267K/S364K/E357Q_(GGGGS)2_IL15Ra(Sushi-D96/C97) (SEQ
ID NOS 1214-1219)**
QVQLVESGGGVVQPGRSLRLDCKASGITFSNSGMHWVRQAPGKGLEWVAVIWYDGSKRYYADSVKGRFTISRDNSKNTLFLQMNSLRAEDTAV
YYCATNDDYWGQGTLVTVSS/ASTKGPSVFPLAPSSKSTSGGTAALGCLVKDYFPEPVTVSWNSGALTSGVHTFPAVLQSSGLYSLSSVVTVP
SSSLGTKTYTCNVNHKPSNTKVDKKVERKSCDKTHTCPRCPAPPVAGPSVFLFPPKPKDTLMISRTPEVTCVVVDVKHEDPEVKFKWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSD
IAVEWESNGQPENNYKTTPPVLDSDGSFFLYSKLTVDKSRWQQGNVFSCSVMHEALHNHYTQKSLSLSPGK/GGGGSGGGGS/ITCPPPMSVE
HADIWVKSYSLYSRERYICNSGFKRKAGTSSLTECVLNKATNVAHWTTPSLKCIRDC

Figure 85M

Chain4—Nivolumab_L0(SEQ ID NOS 1220-1224)
EIVLTQSPATLSLSPGERATLSCRASQSVSSYLAWYQQKPGQAPRLLIYDASNRATGIPARFSGSGSGTDFTLTISSLEPEDFAVYYC**QQSSN
WPRT**FGQGTKVEIK/RTVAAPSVFIFPPSDEQLKSGTASVVCLLNNFYPREAKVQWKVDNALQSGNSQESVTEQDSKDSTYSLSSTLTLSKAD
YEKHKVYACEVTHQGLSSPVTKSFNRGEC <u>1C11[PD-1]_H3L3_bivalent_IL15_N4D/N65D_IL15Ra(sushi)_(GGGGS)1_Fc(216)_IgG1_pI(-
)_Isosteric_A_C220S/PVA_/S267K/L368D/K370S_Fc(216)_IgG1_C220S/PVA_/S267K/S364K/E357Q</u>

**Chain 1 - 1C11[PD-1]_H3_IL15_N4D/N65D_(GGGGS)1_Fc(216)_IgG1_pI(-
)_Isosteric_A_C220S/PVA_/S267K/L368D/K370S (SEQ ID NOS 1225-1231)**
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSC/<u>GGGGSGGGGS</u>/NWVDVISDLKKIEDLIQS
MHIDATLYTESDVHPSCKVTAMKCFLLELQVISLESGDASIHDTVEDLIILANNSLSSNGNVTESGCKECEELEEKN
IKEFLQSFVHIVQMFINTS/<u>GGGGS</u>/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPR
EPQVYTLPPSREEMTKNQVSLTCDVSGFYPSDIAVEWESDGQPENNYKTTPPVLDSDGSFFLYSKLTVDKSRWEQGD
VFSCSVMHEALHNHYTQKSLSLSPGK

**Chain 2 - 1C11[PD-1]_H3_IL15Ra(sushi)_(GGGGS)1_Fc(216)_IgG1_C220S/PVA_/S267K/S364K/E357Q (SEQ ID NOS
1232-1238)**
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSC/<u>GGGGSGGGGS</u>/ITCPPPMSVEHADIWVKS
YSLYSRERYICNSGFKRKAGTSSLTECVLNKATNVAHWTTPSLKCIR/<u>GGGGS</u>/EPKSSDKTHTCPPCPAPPVAGPS
VFLFPPKPKDTLMISRTPEVTCVVVDVKHEDPEVKFNWYVDGVEVHNAKTKPREEQYNSTYRVVSVLTVLHQDWLNG
KEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK

Chain 3 - 1C11[PD-1]_L3 (SEQ ID NOS 1239-1243)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC <u>1C11[PD-1]_H3L3_Fab-IL15Ra(sushi)_(GGGGS)5-IL15(N4D/N65D)-1C11[PD-1]_H3L3_Fab_Fc(216)_IgG1_pI(-
)_Isosteric_A_C220S/PVA_/S267K/L368D/K370S_IgG1_C220S/PVA_/S267K/S364K/E357Q</u>

**Chain 1 - 1C11[PD-1]_H3_IL15Ra(sushi)_(GGGGS)5-IL15(N4D/N65D)_IgG1_pI(-
)_Isosteric_A_C220S/PVA_/S267K/L368D/K370S (SEQ ID NOS 1244-1251)**
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSC/<u>GGGGSGGGGS</u>/ITCPPPMSVEHADIWVKS
YSLYSRERYICNSGFKRKAGTSSLTECVLNKATNVAHWTTPSLKCIR/<u>GGGGSGGGGSGGGGSGGGGSGGGGS</u>/NWVD
VISDLKKIEDLIQSMHIDATLYTESDVHPSCKVTAMKCFLLELQVISLESGDASIHDTVEDLIILANNSLSSNGNVTESGCKECEELEEKNIK
EFLQSFVHIVQMFINTS/EPKSSDKTHTCPPCPAPPVAGPSVFLFPPKPKDTLMISRTPEVTCVVVDVKHEDPEVKFNWY
VDGVEVHNAKTKPREEEYNSTYRVVSVLTVLHQDWLNGKEYKCKVSNKALPAPIEKTISKAKGQPREPQVYTLPPSR
EEMTKNQVSLTCDVSGFYPSDIAVEWESDGQPENNYKTTPPVLDSDGSFFLYSKLTVDKSRWEQGDVFSCSVMHEAL
HNHYTQKSLSLSPGK

Chain 2 - 1C11[PD-1]_H3_IgG1_C220S/PVA_/S267K/S364K/E357Q (SEQ ID NOS 1252-1256)
QIQLVQSGSELKKPGASVKVSCKASGYTFTHYGMNWVRQAPGQGLEWMGWINTYTGEPTYADGFTGRFVFSLDTSVSTAYLQISSLKAEDTAV
YFCARDYYGSSPYWGQGTLVTVSS/ASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPPVAGPSVFLFPPKPKDTL
MISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Figure 85N

Chain 3 – 1C11[PD-1]_L3 (SEQ ID NOS 1257-1261)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYC
FQGSHVPNTFGGGTKVEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC Figure 86A: alternative PD-1 ABDs >pembrolizumab[PD-1] variable heavy Chain (SEQ ID NOS 1262-1265)
QVQLVQSGVEVKKPGASVKVSCKASGYTFTNYYMYWVRQAPGQGLEWMGGINPSNGGTNFNEKFKNRVTLTTDSSTT
TAYMELKSLQFDDTAVYYCARRDYRFDMGFDYWGQGTTVTVSS >pembrolizumab[PD-1] variable light Chain (SEQ ID NOS 1266-1269)
EIVLTQSPATLSLSPGERATLSCRASKGVSTSGYSYLHWYQQKPGQAPRLLIYLASYLESGVPARFSGSGSGTDFTL
TISSLEPEDFAVYYCQHSRDLPLTFGGGTKVEIK >nivolumab[PD-1] variable heavy Chain (SEQ ID NOS 1270-1273)
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS >nivolumab[PD-1] variable light Chain (SEQ ID NOS 1274-1277)
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK >pidilizumab[PD-1] variable heavy Chain (SEQ ID NOS 1278-1281)
QVQLVQSGSELKKPGASVKISCKASGYTFTNYGMNWVRQAPGQGLQWMGWINTDSGESTYAEEFKGRFVFSLDTSVN
TAYLQITSLTAEDTGMYFCVRVGYDALDYWGQGTLVTVSS >pidilizumab[PD-1] variable light Chain (SEQ ID NOS 1282-1285)
EIVLTQSPSSLSASVGDRVTITCSARSSVSYMHWFQQKPGKAPKLWIYRTSNLASGVPSRFSGSGSGTSYCLTINSL
QPEDFATYYCQQRSSFPLTFGGGTKLEIK >MK-3475[PD-1] variable heavy Chain (SEQ ID NOS 1286-1289)
QVQLVQSGVEVKKPGASVKVSCKASGYTFTNYYMYWVRQAPGQGLEWMGGINPSNGGTNFNEKFKNRVTLTTDSSTT
TAYMELKSLQFDDTAVYYCARRDYRFDMGFDYWGQGTTVTVSS >MK-3475[PD-1] variable light Chain (SEQ ID NOS 1290-1293)
EIVLTQSPATLSLSPGERATLSCRASKGVSTSGYSYLHWYQQKPGQAPRLLIYLASYLESGVPARFSGSGSGTDFTL
TISSLEPEDFAVYYCQHSRDLPLTFGGGTKVEIK >BAP049 Clone E[PD-1] variable heavy Chain (SEQ ID NOS 1294-1297)
EVQLVQSGAEVKKPGESLRISCKGSGYTFTTYWMHWVRQATGQGLEWMGNIYPGTGGSNFDEKFKNRVTITADKSTS
TAYMELSSLRSEDTAVYYCTRWTTGTGAYWGQGTTVTVSS >BAP049 Clone E[PD-1] variable light Chain (SEQ ID NOS 1298-1301)
EIVLTQSPATLSLSPGERATLSCKSSQSLLDSGNQKNFLTWYQQKPGQAPRLLIYWASTRESGVPSRFSGSGSGTDF
TFTISSLEAEDAATYYCQNDYSYPYTFGQGTKVEIK >BAP049 Clone B[PD-1] variable heavy Chain (SEQ ID NOS 1302-1305)
EVQLVQSGAEVKKPGESLRISCKGSGYTFTTYWMHWVRQATGQGLEWMGNIYPGTGGSNFDEKFKNRVTITADKSTS
TAYMELSSLRSEDTAVYYCTRWTTGTGAYWGQGTTVTVSS

Figure 86B

```
>BAP049 Clone B[PD-1] variable light Chain (SEQ ID NOS 1306-1309)
EIVLTQSPATLSLSPGERATLSCKSSQSLLDSGNQKNFLTWYQQKPGKAPKLLIYWASTRESGVPSRFSGSGSGTDF
TFTISSLQPEDIATYYCQNDYSYPYTFGQGTKVEIK >H7798N[PD-1] variable heavy Chain (SEQ ID NOS 1310-1313)
EVQLLESGGVLVQPGGSLRLSCAASGFTFSNFGMTWVRQAPGKGLEWVSGISGGGRDTYFADSVKGRFTISRDNSKN
TLYLQMNSLKGEDTAVYYCVKWGNIYFDYWGQGTLVTVSS >H7709N[PD-1] variable light Chain (SEQ ID NOS 1314-1317)
DIQMTQSPSSLSASVGDSITITCRASLSINTFLNWYQQKPGKAPNLLIYAASSLHGGVPSRFSGSGSGTDFTLTIRT
LQPEDFATYYCQQSSNTPFTFGPGTVVDFR >h1H3 Var 6[PD-1] variable heavy Chain (SEQ ID NOS 1318-1321)
EVQLVESGGGLVQPGGSLRLSCAASGFTFSDYGMHWVRQAPGKGLEWVAYISSGSYTIYYADSVKGRFTISRDNAKN
TLYLQMSSLRAEDTAVYYCARRGYGSFYEYYFDYWGQGTTVTVSS >h1H3 Var 6[PD-1] variable light Chain (SEQ ID NOS 1322-1325)
QIVLTQSPATLSLSPGERATLSCSASSSVSYMYWYQQKPGQAPRLLIYLTSNRATGIPARFSGSGSGTDYTLTISSL
EPEDFAVYYCQQWSSNPFTFGQGTKLEIK >APE2058[PD-1] variable heavy Chain (SEQ ID NOS 1326-1329)
EVQLLESGGGLVQPGGSLRLSCAASGFTFSSYDMSWVRQAPGKGLEWVSTISGGGSYTYYQDSVKGRFTISRDNSKN
TLYLQMNSLRAEDTAVYYCASPYYAMDYWGQGTTVTVSS >APE2058[PD-1] variable light Chain (SEQ ID NOS 1330-1333)
DIQLTQSPSFLSAYVGDRVTITCKASQDVGTAVAWYQQKPGKAPKLLIYWASTLHTGVPSRFSGSGSGTEFTLTISS
LQPEDFATYYCQHYSSYPWTFGQGTKLEIK >H005-1[PD-1] variable heavy Chain (SEQ ID NOS 1334-1337)
EVQLVESGGGLVQPGGSLRLSCAASGFTFSSYMMSWVRQAPGKGLEWVATISGGGANTYYPDSVKGRFTISRDNAKN
SLYLQMNSLRAEDTAVYYCARQLYYFDYWGQGTTVTVSS >H005-1[PD-1] variable light Chain (SEQ ID NOS 1338-1341)
DIQMTQSPSSLSASVGDRVTITCLASQTIGTWLTWYQQKPGKAPKLLIYTATSLADGVPSRFSGSGSGTDFTLTISS
LQPEDFATYYCQQVYSIPWTFGGGTKVEIK >317-4B6[PD-1] variable heavy Chain (SEQ ID NOS 1342-1345)
QVQLQESGPGLVKPSETLSLTCTVSGFSLTSYGVHWIRQPPGKGLEWIGVIYADGSTNYNPSLKSRVTISKDTSKNQ
VSLKLSSVTAADTAVYYCARAYGNYWYIDVWGQGTTVTVSS >317-4B6[PD-1] variable light Chain (SEQ ID NOS 1346-1349)
DIVMTQSPDSLAVSLGERATINCKSSESVSNDVAWYQQKPGQPPKLLINYAFHRFTGVPDRFSGSGYGTDFTLTISS
LQAEDVAVYYCHQAYSSPYTFGQGTKLEIK >326-4A3[PD-1] variable heavy Chain (SEQ ID NOS 1350-1353)
QVQLVQSGSELKKPGASVKVSCKASGYTFTNYGMNWVRQAPGQGLKWMGWINNNNAEPTYAQDFRGRFVFSLDTSAS
TAYLQISSLKTEDTAVYYCARDVMDYWGQGTLVTVSS >326-4A3[PD-1] variable light Chain (SEQ ID NOS 1354-1357)
DIVLTQSPASLAVSPGQRATITCRASESVDNYGYSFMHWYQQKPGQPPKLLIYRASNLESGVPARFSGSGSGTDFTL
TINPVEAEDTANYYCQQSKEYPTFGGGTKVEIK >hPD-1 mAb 7 (1.2)[PD-1] variable heavy Chain (SEQ ID NOS 1358-1361)
QVQLVQSGAEVKKPGASVKVSCKASGYSFTSYWMNWVRQAPGQGLEWIGVIHPSDSETWLDQKFKDRVTITVDKSTS
TAYMELSSLRSEDTAVYYCAREHYGTSPFAYWGQGTLVTVSS
```

Figure 86C

```
>hPD-1 mAb 7 (1.2)[PD-1] variable light Chain (SEQ ID NOS 1362-1365)
EIVLTQSPATLSLSPGERATLSCRASESVDNYGMSFMNWFQQKPGQPPKLLIHAASNQGSGVPSRFSGSGSGTDFTL
TISSLEPEDFAVYFCQQSKEVPYTFGGGTKVEIK >Clone 38[PD-1] variable heavy Chain (SEQ ID NOS 1366-1369)
QGQLVQSGAEVKKPGASVKVSCKASGYTFTDYEMHWVRQAPIHGLEWIGVIESETGGTAYNQKFKGRVTITADKSTS
TAYMELSSLRSEDTAVYYCAREGITTVATTYYWYFDVWGQGTTVTVSS >Clone 38[PD-1] variable light Chain (SEQ ID NOS 1370-1373)
DVVMTQSPLSLPVTLGQPASISCRSSQSIVHSNGNTYLEWYLQKPGQSPQLLIYKVSNRFSGVPDRFSGSGSGTDFT
LKISRVEAEDVGVYYCFQGSHVPLTFGQGTKLEIK >Clone 39[PD-1] variable heavy Chain (SEQ ID NOS 1374-1377)
QGQLVQSGAEVKKPGASVKVSCKASGYTFTDYEMHWVRQAPGQGLEWMGVIESETGGTAYNQKFKGRAKITADKSTS
TAYMELSSLRSEDTAVYYCTREGITTVATTYYWYFDVWGQGTTVTVSS >Clone 39[PD-1] variable light Chain (SEQ ID NOS 1378-1381)
DVVMTQSPLSLPVTLGQPASISCRSSQSIVHSNGNTYLEWYLQKPGQSPQLLIYKVSNRFSGVPDRFSGSGSGTDFT
LKISRVEAEDVGVYYCFQGSHVPLTFGQGTKLEIK >Clone 41[PD-1] variable heavy Chain (SEQ ID NOS 1382-1385)
QGQLVQSGAEVKKPGASVKVSCKASGYTFTDYEMHWVRQAPGQGLEWMGVIESETGGTAYNQKFQGRVTLTADKSSS
TAYMELSSLRSEDTAVYYCTREGITTVATTYYWYFDVWGQGTLVTVSS >Clone 41[PD-1] variable light Chain (SEQ ID NOS 1386-1389)
DVVMTQSPLSLPVTLGQPASISCRSSQSIVHSNGNTYLEWYLQKPGQSPQLLIYKVSNRFSGVPDRFSGSGSGTDFT
LKISRVEAEDVGVYYCFQGSHVPLTFGQGTKLEIK >Clone 48[PD-1] variable heavy Chain (SEQ ID NOS 1390-1393)
QGQLVQSGAEVKKPGASVKVSCKASGYTFTDYEMHWVRQAPGQGLEWMGVIESETGGTAYNQKFKGRAKITADKSTS
TAYMELSSLRSEDTAVYYCTREGITTVATTYYWYFDVWGQGTTVTVSS >Clone 48[PD-1] variable light Chain (SEQ ID NOS 1394-1397)
DVVMTQSPLSLPVTLGQPASISCRSSQSIVHSNGNTYLEWYLQKPGQSPRLLIYKVSNRFSGVPDRFSGSGSGTDFT
LKISRVEAEDVGVYYCFQGSHVPLTFGQGTKLEIK >PD1-17[PD-1] variable heavy Chain (SEQ ID NOS 1398-1401)
QVQLQESGPGVVKPSGTLSLTCAISGGSIGSGGSIRSTRWWSWVRQSPGKGLEWIGEIYHSGSTNYNPSLKSRVTIS
LDKSRNHFSLRLNSVTAADTAVYYCARQDYGDSGDWYFDLWGKGTMVTVSS >PD1-17[PD-1] variable light Chain (SEQ ID NOS 1402-1405)
NFMLTQPHSVSESPGKTVTISCTRSSGSIASNSVQWYQQRPGSSPTTVIYEDNQRPSGVPDRFSGSIDSSSNSASLT
VSGLKTEDEADYYCQSSDSSAVVFGSGTKLTVL >PD1-28[PD-1] variable heavy Chain (SEQ ID NOS 1406-1409)
EVQLVQSGAEVKKPGASVKVSCKASGYRFTSYGISWVRQAPGQGLEWMGWISAYNGNTNYAQKLQGRVTMTTDTSTN
TAYMELRSLRSDDTAVYYCARDADYSSGSGYWGQGTLVTVSS >PD1-28[PD-1] variable light Chain (SEQ ID NOS 1410-1413)
SYELTQPPSVSVSPGQTARITCSGDALPKQYAYWYQQKPGQAPVMVIYKDTERPSGIPERFSGSSSGTKVTLTISGV
QAEDEADYYCQSADNSITYRVFGGGTKVTVL >PD1-33[PD-1] variable heavy Chain (SEQ ID NOS 1414-1417)
QVQLVQSGAEVKKPGASVRVSCKASGYTLTSYYIHWVRQAPGQGLEWMGIINPRGATISYAQKFQGRVTMTRDTSTS
TVYMELRNLKSEDTALYYCATAGIYGFDFDYWGRGTLVTVSS
```

Figure 86D

>PD1-33[PD-1] variable light Chain (SEQ ID NOS 1418-1421)
QSALTQPASVSGSPGQSITISCTGTSNDVGGYNYVSWYQHHPGKAPKLIIYDVTNRPSGVSDRFSGSKSGNTASLTI
SGLLAEDEGDYYCSSYTIVTNFEVLFGGGTKLTV >PD1-35[PD-1] variable heavy Chain (SEQ ID NOS 1422-1425)
QVQLQESGPGLVKPSQTLSLTCTVSGGSISSGAYYWSWIRQHPGKGLEWIGYIYYNGNTYYNPSLRSLVTISVDASK
NQFSLKLSSVTAADTAVYYCARASDYVWGGYRYMDAFDIWGRGTLITVSS >PD1-35[PD-1] variable light Chain (SEQ ID NOS 1426-1429)
QSVLTQPPSASGTPGQRVTISCSGSNSNIGSNSVNWYQQLPGTAPKLLIYGNNQRPSGVPDRFSGSKSGTSASLAIS
GLQSENEADYYCAAWDDSLNGPVFGRGTKVTVLGE >LOPD180[PD-1] variable heavy Chain (SEQ ID NOS 1430-1433)
QVQLQESGPGLVKPSQTLSLTCTVSGGSISSGAYYWSWIRQHPGKGLEWIGYIYYNGNTYYNPSLRSRVTISVDTSK
NQFSLKLSSVTAADTAVYYCVRASDYVWGGYHYFDAFDLWGRGTLVTVSS >LOPD180[PD-1] variable light Chain (SEQ ID NOS 1434-1437)
QSVLTQPPSASGTPGQRVTISCSGSNSNIGSNSVNWYQQLPGTAPKLLIYGNNQRPSGVPDRFSGSKSGTSASLAIS
GLQSEDEADYYCAAWDDSLNGPVFGGGTKVTVL >Ab948[PD-1] variable heavy Chain (SEQ ID NOS 1438-1441)
EVQLQESGPGLVKPSQTLSLTCTVTGYSITSDYAWNWIRQPPGKKLEWMGYINYSGSTSYNPSLKSRVTISRDTSKN
QFSLKLSSVTAADTAVYYCARWIGSSAWYFDVWGQGTLVTVS >Ab948[PD-1] variable light Chain (SEQ ID NOS 1442-1445)
DVLMTQTPLSLSVTPGQPASISCRSGQNIVHSNGNTYLEWYLQKPGQSPKLLIYKVSNRFFGVPDRISGSGSGTDFT
LKISRVEAEDVGVYFCFQGSHVPFTFGQGTKLEIK >humanized EH-12.2H7[PD-1] variable heavy Chain (SEQ ID NOS 1446-1449)
QVQLVQSGHEVKQPGASVKMSCKASGYSFTSSWIHWVRQAPGQGLEWIGYIYPSTGFTEYNQKFKDRATLTADKSTS
TAYMELSSLRSEDTAVYYCARWRDSSGYHAMDYWGQGTLVTVSS >humanized EH-12.2H7[PD-1] variable light Chain (SEQ ID NOS 1450-1453)
EIVLTQSPATLSLSPGQRLTISCRASQSVSTSGYSYMHWYQQKPDQSPKLLIKFGSNLESGIPARFSGSGSGTDFTL
TISSLEPEDFATYYCQHSWEIPYTFGQGTKLEIK >RG1H10[PD-1] variable heavy Chain (SEQ ID NOS 1454-1457)
QVQLVQSGSELKKPGASVKISCKASGYIFSDNGVNWVRQAPGQGLEWMGWINTKIGNPTYAQGFTGRFVFSLDTSIS
TTYLQISSLQAGDTAVYYCAREHDYYYGMDVWGQGTTVTVSS >RG1H10[PD-1] variable light Chain (SEQ ID NOS 1458-1461)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-H2A-22-1S[PD-1] variable heavy Chain (SEQ ID NOS 1462-1465)
QVQLVQSGSELKKPGASVKISCKASGYIFSDNGVNWVRQAPGQGLEWMGWINTKDGNPTYAQGFTGRFVFSLDTSIS
TTYLQISSLQAGDTAVYYCAREHDYYYGMDVWGQGTTVTVSS >RG1H10-H2A-22-1S[PD-1] variable light Chain (SEQ ID NOS 1466-1469)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-H2A-27-2S[PD-1] variable heavy Chain (SEQ ID NOS 1470-1473)
QVQLVQSGSELKKPGASVKISCKASGYIFSDNGVNWVRQAPGQGLEWMGWINTKTGNPTYAQGFTGRFVFSLDTSIS
TTYLQISSLQAGDTAVYYCAREHDYYYGMDVWGQGTTVTVSS

Figure 86E

>RG1H10-H2A-27-2S[PD-1] variable light Chain (SEQ ID NOS 1474-1477)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-3C[PD-1] variable heavy Chain (SEQ ID NOS 1478-1481)
QVQLVQSGSELKKPGASVKISCKASGYTFSDNGVNWVRQAPGQGLEWMGWINTKDGNPTYAQGFTGRFVFSLDTSIS
TTYLQISSLQAGDTAVYYCAREHDYYYGMDVWGQGTTVTVSS >RG1H10-3C[PD-1] variable light Chain (SEQ ID NOS 1482-1485)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-16C[PD-1] variable heavy Chain (SEQ ID NOS 1486-1489)
QVQLVQSGSELKKPGASVKISCKASGYTFSDNGVNWVRQAPGQGLEWMGWINTKTGNPTYAQGFTGRFVFSLDTSIS
TTYLQISSLQAGDTAVYYCAREHDYYYGMDVWGQGTTVTVS >RG1H10-16C[PD-1] variable light Chain (SEQ ID NOS 1490-1493)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-17C[PD-1] variable heavy Chain (SEQ ID NOS 1494-1497)
QVQLVQSGSELKKPGASVKISCKASGYKFSDNGVNWVRQAPGQGLEWMGWINTKSGNPTYAQGFTGRFVFSLDTSIS
TTYLQISSLQAGDTAVYYCAREHDYYYGMDVWGQGTTVTVSS >RG1H10-17C[PD-1] variable light Chain (SEQ ID NOS 1498-1501)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-19C[PD-1] variable heavy Chain (SEQ ID NOS 1502-1505)
QVQLVQSGSELKKPGASVKISCKASGYKFSDNGVNWVRQAPGQGLEWMGWINTKTGNPTYAQGFTGRFVFSLDTSIS
TTYLQISSLQAGDTAVYYCAREHDYYYGMDVWGQGTTVTVSS >RG1H10-19C[PD-1] variable light Chain (SEQ ID NOS 1506-1509)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-21C[PD-1] variable heavy Chain (SEQ ID NOS 1510-1513)
QVQLVQSGSELKKPGASVKISCKASGYTFSDNGVNWVRQAPGQGLEWMGWINTKSGNPTYAQGFTGRFVFSLDTSIS
TTYLQISSLQAGDTAVYYCAREHDYYYGMDVWGQGTTVTVSS >RG1H10-21C[PD-1] variable light Chain (SEQ ID NOS 1514-1517)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-23C2[PD-1] variable heavy Chain (SEQ ID NOS 1518-1521)
QVQLVQSGSELKKPGASVKISCKASGYKFSDNGVNWVRQAPGQGLEWMGWINTKDGNPTYAQGFTGRFVFSLDTSIS
TTYLQISSLQAGDTAVYYCAREHDYYYGMDVWGQGTTVTVSS >RG1H10-23C2[PD-1] variable light Chain (SEQ ID NOS 1522-1525)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >mAb7[PD-1] variable heavy Chain (SEQ ID NOS 1526-1529)
QVQLVQSGAEVKKPGASVKVSCKASGYTFTSYWINWVRQAPGQGLEWMGNIYPGSSLTNYNEKFKNRVTMTRDTSTS
TVYMELSSLRSEDTAVYYCARLSTGTFAYWGQGTLVTVSS

Figure 86F

>mAb7[PD-1] variable light Chain (SEQ ID NOS 1530-1533)
DIVMTQSPDSLAVSLGERATINCKSSQSLWDSGNQKNFLTWYQQKPGQPPKLLIYWTSYRESGVPDRFSGSGSGTDF
TLTISSLQAEDVAVYYCQNDYFYPHTFGGGTKVEIK >PD1AB-6[PD-1] variable heavy Chain (SEQ ID NOS 1534-1537)
EVQLVQSGAEVKKPGATVKISCKASGFNIKDTYMHWVQQAPGKGLEWMGRIDPANGDRKYDPKFQGRVTITADTSTD
TAYMELSSLRSEDTAVYYCARSGPVYYYGSSYVMDYWGQGTTVTVSS >PD1AB-6[PD-1] variable light Chain (SEQ ID NOS 1538-1541)
DIVMTQSPDSLAVSLGERATINCKSGQSVLYSSNQKNFLAWYQQKPGQPPKLLIYWASTRESGVPDRFSGSGSGTDF
TLTISSLQAEDVAVYYCHQYLYSWTFGQGTKLEIK Figure 87A scIL-15/Rα(sushi) (SEQ ID NOS 1542-1544)

ITCPPPMSVEHADIWVKSYSLYSRERYICNSGFKRKAGTSSLTECVLNKATNVAHWTTPSLKCIR/GGGGSGGGGSGGGGSGGGGSGGGGSGG
GGS/NWVNVISDLKKIEDLIQSMHIDATLYTESDVHPSCKVTAMKCFLLELQVISLESGDASIHDTVENLIILANNSLSSNGNVTESGCKECE
ELEEKNIKEFLQSFVHIVQMFINTS

Figure 87B ds IL-15/Rα(sushi)

Chain 1 – IL-15(E87C) (SEQ ID NO: 1545)
NWVNVISDLKKIEDLIQSMHIDATLYTESDVHPSCKVTAMKCFLLELQVISLESGDASIHDTVENLIILANNSLSSNGNVTESGCKCCEELEE
KNIKEFLQSFVHIVQMFINTS

IL-15/Rα: IL15Ra(Sushi-D96/C97) (SEQ ID NO: 1546)
ITCPPPMSVEHADIWVKSYSLYSRERYICNSGFKRKAGTSSLTECVLNKATNVAHWTTPSLKCIRDC

Figure 88

| XENP | Heterodimer-skewing variant, Chain 1 | Heterodimer-skewing variant, Chain 2 | Heterodimer Yield (%) | CH3 Tm (°C) |
| --- | --- | --- | --- | --- |
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

BISPECIFIC HETERODIMERIC FUSION PROTEINS CONTAINING IL-15-IL-15Rα FC-FUSION PROTEINS AND PD-1 ANTIBODY FRAGMENTS

PRIORITY CLAIM

This application claims priority to U.S. Ser. No. 62/408,655, filed on Oct. 14, 2016, U.S. Ser. No. 62/416,087, filed on Nov. 1, 2016, U.S. Ser. No. 62/443,465, filed on Jan. 6, 2017, and U.S. Ser. No. 62/477,926, filed on Mar. 28, 2017, which are expressedly incorporated herein by reference in their entirety, with particular reference to the figures, legends, and claims therein.

SEQUENCE LISTING

The instant application contains a Sequence Listing which has been submitted electronically in ASCII format and is hereby incorporated by reference in its entirety. Said ASCII copy, created on Jan. 16, 2018, is named 067461-5202-WO_SL.txt and is 1,801,289 bytes in size.

BACKGROUND OF THE INVENTION

IL-2 and IL-15 function in aiding the proliferation and differentiation of B cells, T cells, and NK cells. IL-2 is also essential for regulatory T cell (Treg) function and survival. Both cytokines exert their cell signaling function through binding to a trimeric complex consisting of two shared receptors, the common gamma chain (γc; CD132) and IL-2 receptor B-chain (IL-2Rβ; CD122), as well as an alpha chain receptor unique to each cytokine: IL-2 receptor alpha (IL-2Rα; CD25) or IL-15 receptor alpha (IL-15Rα; CD215). Both cytokines are considered as potentially valuable therapeutics in oncology and IL-2 has been approved for use in patients with metastatic renal-cell carcinoma and malignant melanoma. Currently there are no approved uses of recombinant IL-15, although several clinical trials are ongoing.

IL-2 presents several challenges as a therapeutic agent. First, it preferentially activates T cells that express the high affinity receptor complex, which depends on CD25 expression. Because Treg cells constitutively express CD25, they compete for IL-2 with effector T cells, whose activation is preferred for oncology treatment. This imbalance has led to the concept of high dose IL-2. However, this approach creates additional problems because of IL-2-mediated toxicities such as vascular leak syndrome.

IL-2 is secreted primarily by activated T cells, while its receptors are located on activated T cells, Tregs, NK cells, and B cells. In contrast, IL-15 is produced on monocytes and dendritic cells and is primarily presented as a membrane-bound heterodimeric complex with IL-15Rα present on the same cells. Its effects are realized through trans-presentation of the IL-15/IL-15Rα complex to NK cells and CD8+ T cells expressing IL-2Rβ and the common gamma chain.

As potential drugs, both cytokines suffer from a very fast clearance, with half-lives measured in minutes. In addition, IL-15 by itself is less stable due to its preference for the IL-15Rα-associated complex. It has also been shown that recombinantly produced IL-15/IL-15Rα heterodimer can potently activate T cells. Nevertheless, a short half-life hinders favorable dosing.

Checkpoint receptors such as PD-1 (programmed cell death 1) inhibit the activation, proliferation, and/or effector activities of T cells and other cell types. Guided by the hypothesis that checkpoint receptors suppress the endogenous T cell response against tumor cells, preclinical and clinical studies of anti-CTLA4 and anti-PD1 antibodies, including nivolumab, pembrolizumab, ipilimumab, and tremelimumab, have indeed demonstrated that immune checkpoint blockade results in impressive anti-tumor responses, stimulating endogenous T cells to attack tumor cells, leading to long-term cancer remissions in a fraction of patients with a variety of malignancies. Unfortunately, only a subset of patients responds to these therapies, with response rates generally ranging from 10 to 30% and sometimes higher for each monotherapy, depending on the indication and other factors. Therapeutic combination of these agents, for example, ipilimumab plus nivolumab, leads to even higher response rates, approaching 60% in some cases. Preclinical studies have shown additional synergies between anti-PD1 antibodies and/or anti-CTLA4 antibodies. While the potential of multiple checkpoint blockade is very promising, combination therapy with such agents is expected to carry a high financial burden. Moreover, autoimmune toxicities of combination therapies, for example nivolumab plus ipilimumab, are significantly elevated compared to monotherapy, causing many patients to halt the therapy.

Accordingly, the present invention is directed to bispecific heterodimeric fusion proteins that contain an IL-15/IL-15Rα complex-Fc fusion and an antibody fragment that binds to a PD-1 antigen.

BRIEF SUMMARY OF THE INVENTION

In one aspect, the present invention provides a bispecific heterodimeric protein comprising (a) a fusion protein comprising a first protein domain, a second protein domain, and a first Fc domain, wherein the first protein domain is covalently attached to the N-terminus of the second protein domain using a first domain linker, wherein the second protein domain is covalently attached to the N-terminus of said first Fc domain using a second domain linker, and wherein the first protein domain comprises an IL-15Rα protein and the second protein domain comprises an IL-15 protein; and (b) an antibody fusion protein comprising an PD-1 antigen binding domain and a second Fc domain, wherein the PD-1 antigen binding domain is covalently attached to the N-terminus of the second Fc domain, and the PD-1 antigen binding domain is a single chain variable fragment (scFv) or a Fab fragment. The first and the second Fc domains can have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some embodiments, the first and/or the second Fc domains have an additional set of amino acid substitutions comprising Q295E/N384D/Q418E/N421D, according to EU numbering. Optionally, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In other aspects of the present invention, provided herein is a bispecific heterodimeric protein comprising: (a) a fusion protein comprising a first protein domain and a first Fc domain, wherein the first protein domain is covalently attached to the N-terminus of the first Fc domain using a domain linker and the first protein domain comprises an IL-15Rα protein; (b) a second protein domain noncovalently attached to the first protein domain, the second protein domain comprises an IL-15 protein; and (c) an antibody fusion protein comprising an PD-1 antigen binding domain and a second Fc domain, wherein the PD-1 antigen binding domain is covalently attached to the N-terminus of the second Fc domain and said said PD-1 antigen binding domain is a single chain variable fragment (scFv) or a Fab fragment. The first and the second Fc domains can have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some embodiments, the first and/or the second Fc domains have an additional set of amino acid substitutions comprising Q295E/N384D/Q418E/N421D, according to EU numbering. In other instances, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some aspects of the present invention, provided herein is a bispecific heterodimeric protein comprising: (a) a first antibody fusion protein comprising a first PD-1 antigen binding domain and a first Fc domain, wherein the first PD-1 antigen binding domain is covalently attached to the N-terminus of the first Fc domain via a first domain linker, and the first PD-1 antigen binding domain is a single chain variable fragment (scFv) or a Fab fragment; (b) a second antibody fusion protein comprising a second PD-1 antigen binding domain, a second Fc domain, and a first protein domain, wherein the second PD-1 antigen binding domain is covalently attached to the N-terminus of the second Fc domain via a second domain linker, the first protein domain is covalently attached to the C-terminus of the second Fc domain via a third domain linker, the second PD-1 antigen binding domain is a single chain variable fragment (scFv) or a Fab fragment, and the first protein domain comprises an IL-15Rα protein; and (c) a second protein domain noncovalently attached to the first protein domain of the second antibody fusion protein and comprising an IL-15 protein. In some embodiments, the first and the second Fc domains can have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some embodiments, the first and/or the second Fc domains have an additional set of amino acid substitutions comprising Q295E/N384D/Q418E/N421D, according to EU numbering. In other instances, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some aspects, the IL15 protein of the bispecific heterodimeric protein described herein has one or more amino acid substitutions selected from the group consisting of N1D, N4D, D8N, D30N, D61N, E64Q, N65D, and Q108E.

In other aspects, provided herein is a bispecific heterodimeric protein selected from the group consisting of XENP25850, XENP25937, XENP21480, XENP22022, XENP22112, XENP22641, XENP22642, and XENP22644.

Nucleic acids, expression vectors and host cells are all provided as well, in addition to methods of making these proteins and treating patients with them.

BRIEF DESCRIPTION OF THE DRAWINGS

FIG. 2A-2B depicts the sequences for IL-15 and its receptors.

FIG. 3A-3E depicts useful pairs of Fc heterodimerization variant sets (including skew and pI variants). There are variants for which there are no corresponding "monomer 2" variants; these are pI variants which can be used alone on either monomer. In addition, reference is made to FIG. 88.

FIG. 4 depict a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 5 depict useful ablation variants that ablate FcγR binding (sometimes referred to as "knock outs" or "KO" variants). Generally, ablation variants are found on both monomers, although in some cases they may be on only one monomer.

FIG. 6A-6E shows a particularly useful embodiments of "non-cytokine" components of the IL-15/Rα-Fc fusion proteins of the invention, as filed concurrently with the present case on 16 Oct. 2017 entitled "IL15/IL15Rα Heterodimeric Fc-fusion Proteins" and U.S. Ser. No. 62/408,655, filed on Oct. 14, 2016, U.S. Ser. No. 62/443,465, filed on Jan. 6, 2017, and U.S. Ser. No. 62/477,926, filed on Mar. 28, 2017, hereby incorporated by reference in their entirety and in particular for the sequences outlined therein.

FIG. 7A-7F shows particularly useful embodiments of "non-cytokine"/"non-Fv" components of the IL-15/Rα× anti-PD-1 bifunctional proteins of the invention. For each, the inclusion of the 428L/4345 FcRn half life extension variants can be added.

FIG. 8 depicts a number of exemplary variable length linkers for use in IL-15/Rα-Fc fusion proteins. In some embodiments, these linkers find use linking the C-terminus of IL-15 and/or IL-15Rα(sushi) to the N-terminus of the Fc region. In some embodiments, these linkers find use fusing IL-15 to the IL-15Rα(sushi).

FIG. 9A-9C depict a number of charged scFv linkers that find use in increasing or decreasing the pI of heterodimeric fusion proteins that utilize one or more scFv as a component. The (+H) positive linker finds particular use herein. A single prior art scFv linker with single charge is referenced as "Whitlow", from Whitlow et al., Protein Engineering 6(8): 989-995 (1993). It should be noted that this linker was used for reducing aggregation and enhancing proteolytic stability in scFvs.

FIG. 10A-10D shows the sequences of several useful IL-15/Rα-Fc format backbones based on human IgG1, without the cytokine sequences (e.g. the Il-15 and/or IL-15Rα (sushi)). It is important to note that these backbones can also find use in certain embodiments of IL-15/Rα×anti-PD-1 bifunctional proteins. Backbone 1 is based on human IgG1 (356E/358M allotype), and includes C220S on both chains, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes C220S on both chain, the S364K:L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/358M allotype), and includes C220S on both chain, the S364K:L368E/K370S skew variants, the Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes C220S on both chain, the D401K:K360E/Q362E/T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes C220S on both chain, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes C220S on both chain, the S364K/E357Q:L368D/K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Alternative formats for backbones 6 and 7 can exclude the ablation variants E233P/L234V/L235A/G236del/S267K in both chains. Backbone 8 is based on human IgG4, and includes the S364K/E357Q:L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the Q295E/N384D/Q418E/N421D pI variants on the chain with L368D/K370S skew variants. Backbone 10 is based on human IgG2, and includes the S364K/E357Q:L368D/K370S skew variants, the Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes C220S on both identical chain, the the E233P/L234V/L235A/G236del/S267K ablation variants on both identical chains. Backbone 13 is based on human IgG1 (356E/358M allotype), and includes C220S on both chain, the S364K/E357Q:L368D/K370S skew variants, the P217R/P229R/N276K pI variants on the chain with S364K/E357Q skew variants and the E233P/L234V/L235A/G236del/S267K ablation variants on both chains.

Figure 1:
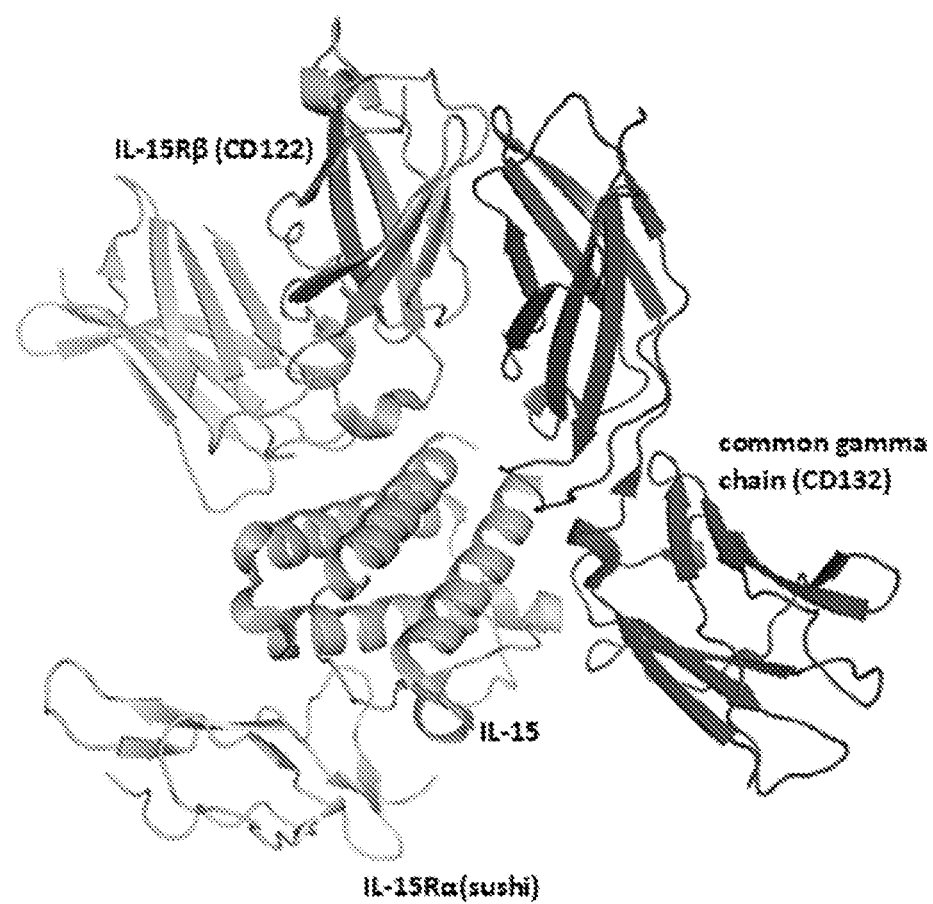
FIG. 1 depicts the structure of IL-15 in complex with its receptors IL-15Rα (CD215), IL-15Rβ (CD122), and the common gamma chain (CD132).

As will be appreciated by those in the art and outlined below, these sequences can be used with any IL-15 and IL-15Rα(sushi) pairs outlined herein, including but not limited to IL-15Rα-heteroFc, ncIL-15/Rα, and scIL-15/Rα, as schematically depicted in FIGS. 64A-64K. Additionally, any IL-15 and/or IL-15Rα(sushi) variants can be incorporated into these FIG. 10 backbones in any combination.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 11 shows the sequences of several useful IL-15/Rα× anti-PD-1 bifunctional format backbones based on human IgG1, without the cytokine sequences (e.g. the Il-15 and/or IL-15Rα(sushi)) or VH, and further excluding light chain backbones which are depicted in FIGS. 10A-10D. Backbone 1 is based on human IgG1 (356E/358M allotype), and includes the S364K/E357Q:L368D/K370S skew variants, C220S and the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes the S364K/E357Q:L368D/K370S skew variants, the N208D/Q295E/N384D/Q418E/N421D pI variants on the chain with L368D/K370S skew variants, C220S in the chain with S364K/E357Q variants, and the E233P/L234V/L235A/G236del/S267K ablation variants on both chains. Backbone 3 is based on human IgG1 (356E/358M allotype), and includes the S364K/E357Q:L368D/K370S skew variants, the N208D/Q295E/N384D/Q418E/N421D pI variants on the chains with L368D/K370S skew variants, the Q196K/I199T/P217R/P228R/N276K pI variants on the chains with S364K/E357Q variants, and the E233P/L234V/L235A/G236del/S267K ablation variants on both chains.

In certain embodiments, these sequences can be of the 356D/358L allotype. In other embodiments, these sequences can include either the N297A or N297S substitutions. In some other embodiments, these sequences can include the M428L/N434S Xtend mutations. In yet other embodiments, these sequences can instead be based on human IgG4, and include a S228P (EU numbering, this is S241P in Kabat) variant on both chains that ablates Fab arm exchange as is known in the art. In yet further embodiments, these sequences can instead be based on human IgG2. Further, these sequences may instead utilize the other skew variants, pI variants, and ablation variants depicted in FIG. 3.

As will be appreciated by those in the art and outlined below, these sequences can be used with any IL-15 and IL-15Rα(sushi) pairs outlined herein, including but not limited to scIL-15/Rα, ncIL-15/Rα, and dsIL-15Rα, as schematically depicted in FIGS. 64A-64K. Further as will be appreciated by those in the art and outlined below, any IL-15 and/or IL-15Rα(sushi) variants can be incorporated in these backbones. Furthermore as will be appreciated by those in the art and outlined below, these sequences can be used with any VH and VL pairs outlined herein, including either a scFv or a Fab.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 12 depicts the "non-Fv" backbone of light chains (i.e. constant light chain) which find use in IL-15/Rα×anti-PD-1 bifunctional proteins of the invention.

FIG. 13A-13E depicts the sequences for a select number of anti-PD-1 antibodies. It is important to note that these sequences were generated based on human IgG1, with an ablation variant (E233P/L234V/L235A/G236del/S267K, "IgG1_PVA_/S267k"). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 14A-14F depict a select number of PD-1 ABDs, with additional anti-PD-1 ABDs being listed as SEQ ID Nos: XXX. The CDRs are underlined, the scFv linker is double underlines (in the sequences, the scFv linker is a positively charged scFv (GKPGS)$_4$ linker (SEQ ID NO: 5), although as will be appreciated by those in the art, this linker can be replaced by other linkers, including uncharged or negatively charged linkers, some of which are depicted in FIGS. 9A-9C, and the slashes indicate the border(s) of the variable domains> In addition, the naming convention illustrates the orientation of the scFv from N- to C-terminus; some of the sequences in this Figure are oriented as $V_H$-scFv linker-$V_L$ (from N- to C-terminus), while some are oriented as $V_L$-scFv linker-$V_H$ (from N- to C-terminus), although as will be appreciated by those in the art, these sequences may also be used in the opposition orientation from their depiction herein. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 15 depicts the sequences for XENP21575, a chimeric anti-PD-1 antibody based on the variable regions of hybridoma clone 1C11 and human IgG1 with E233P/L234V/L235A/G236del/S267K substitutions in the heavy chain. The CDRs are in bold, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems.

Figure 16:
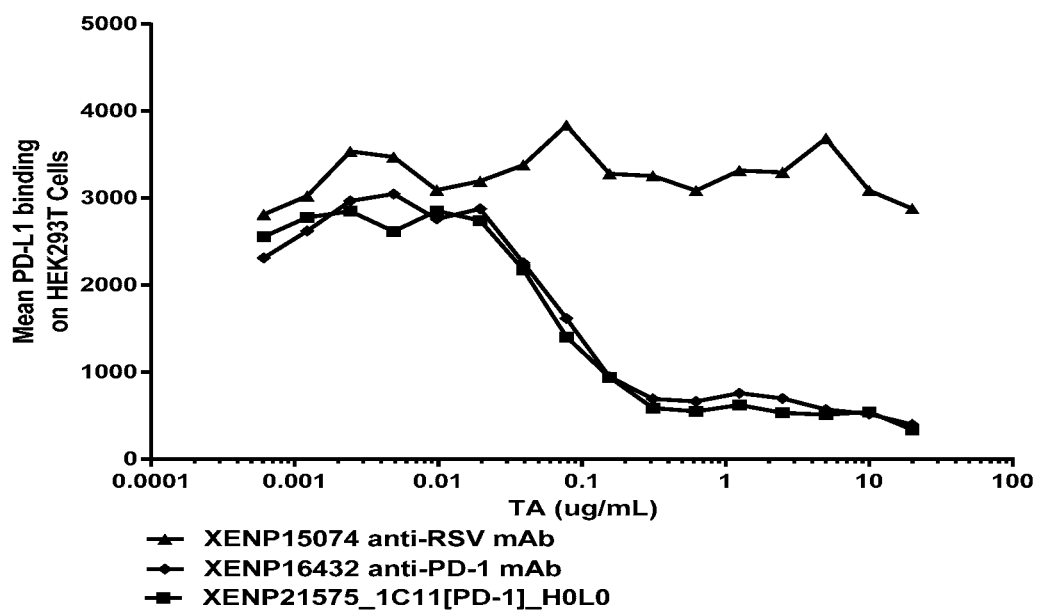

FIG. 16 depicts blocking of PD-1/PD-L1 interaction on PD-1 transfected HEK293T cells by anti-PD-1 clone 1C11.

Figure 17:
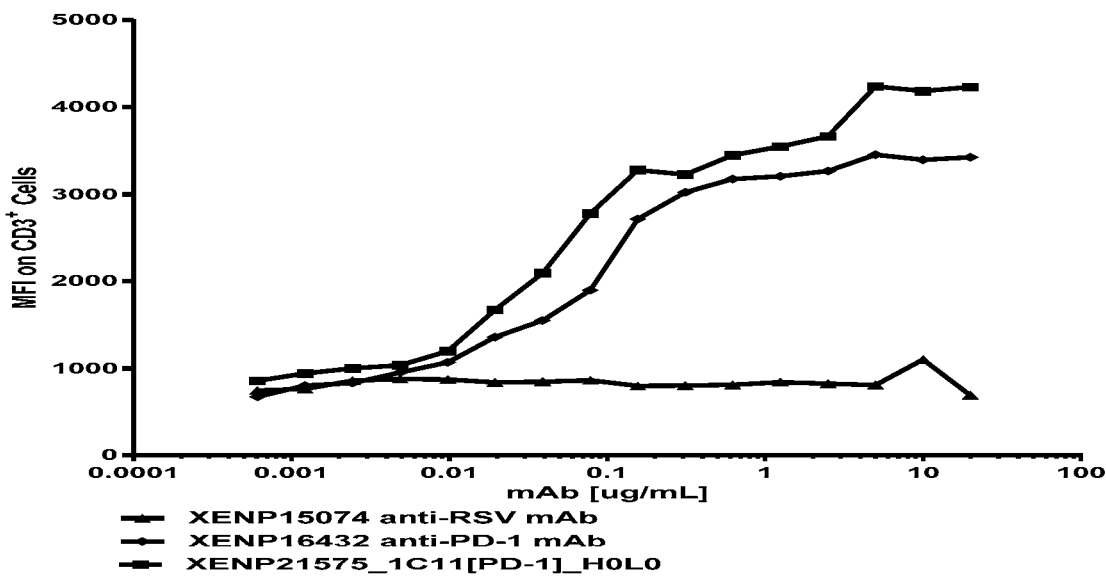

FIG. 17 depicts the binding of anti-PD-1 clone 1C11 to SEB-stimulated T cells.

Figure 18A:
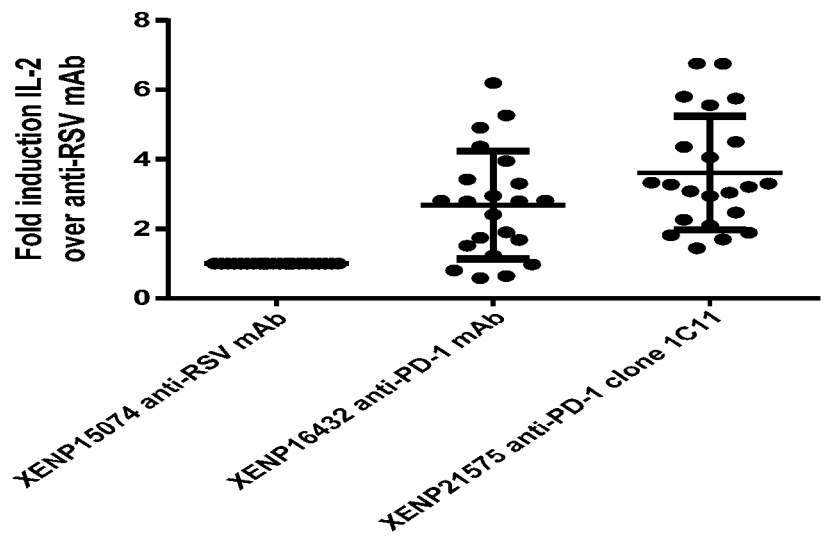
Figure 18B:
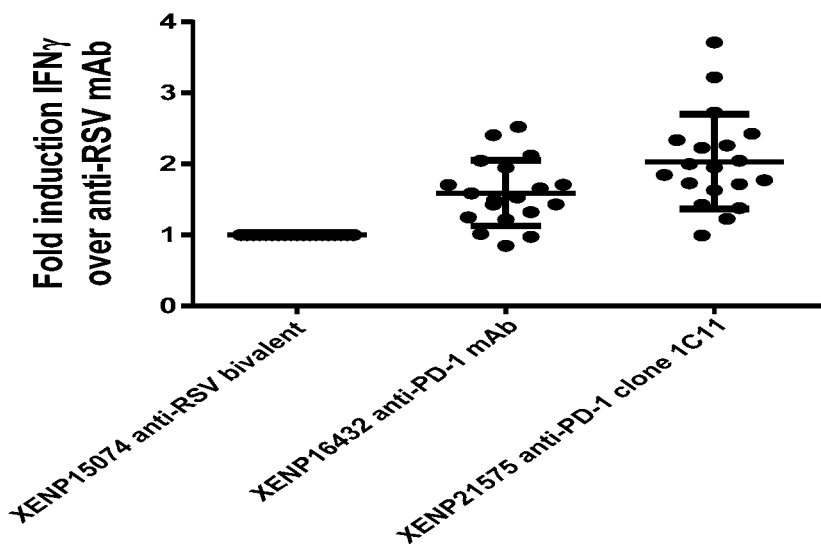
Figure 21A:
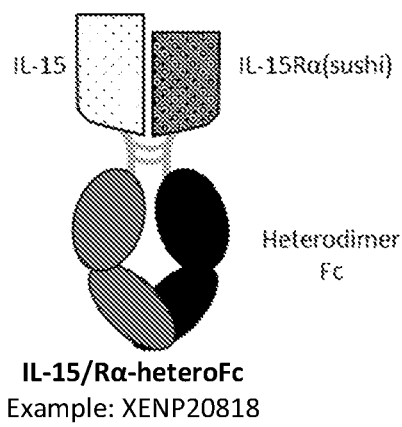
Figure 21B:
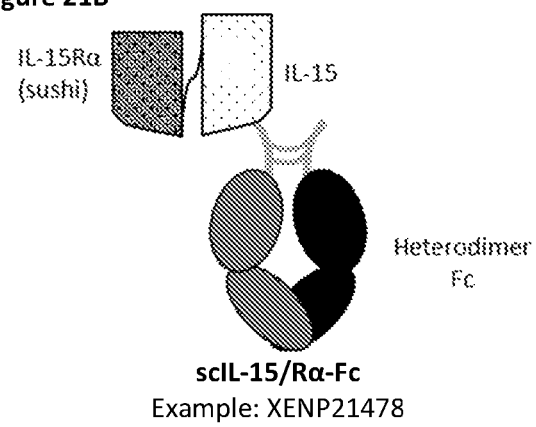
Figure 21C:
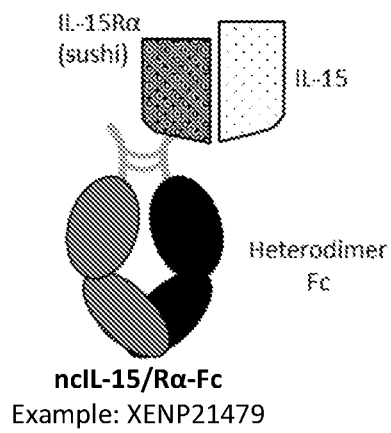
Figure 21D:
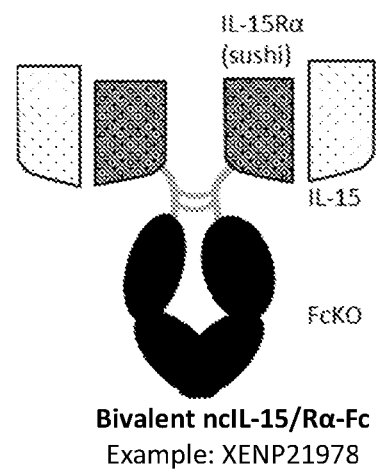
Figure 21E:
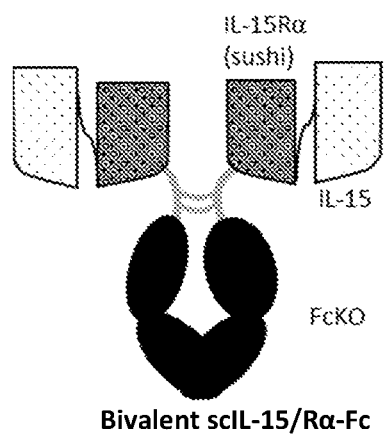
Figure 21F:
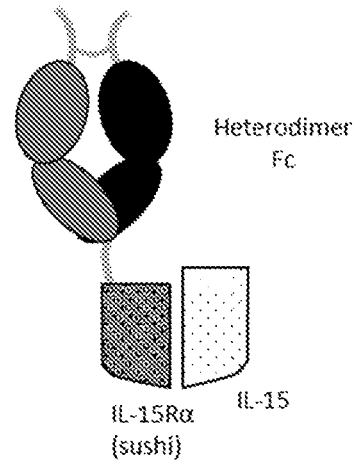
Figure 21G:
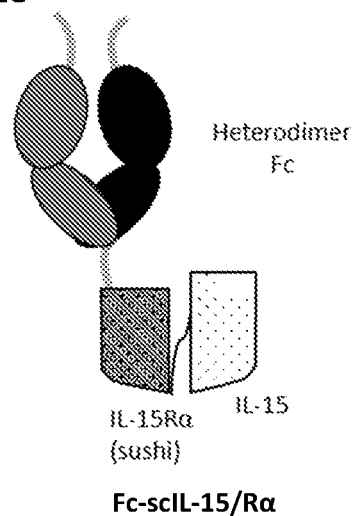

FIG. 18A-18B depicts cytokine release assays (A: IL-2; B: IFNγ) after SEB stimulation of human PBMCs and treatment with anti-PD-1 clone 1C11.

FIG. 19 depicts the sequences for an illustrative humanized variant of anti-PD-1 clone 1C11 in bivalent antibody (XENP22553) in the human IgG1 format with E233P/L234V/L235A/G236del/S267K substitutions in the heavy chain. The CDRs are in bold, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. Sequences for additional humanized variants of anti-PD-1 clone 1C11 are depicted as SEQ ID NOs: 832-931 and 942-951 (include XENPs 22543, 22544, 22545, 22546, 22547, 22548, 22549, 22550, 22551, 22552, and 22554). As will be appreciated by those in the art, the $V_H$ and $V_L$ domains can be formatted as Fab or scFvs for use in the IL-15/Rα×anti-PD-1 bifunctional proteins of the invention.

FIG. 20 depicts the affinity of XENP22553 for PD-1 as determined by Octet (as well as the associated sensorgram).

FIG. 21A-21G depict several formats for the IL-15/Rα-Fc fusion proteins of the present invention. IL-15Rα Heterodimeric Fc fusion or "IL-15/Rα-heteroFc" (FIG. 21A) comprises IL-15 recombinantly fused to one side of a heterodimeric Fc and IL-15Rα(sushi) recombinantly fused to the other side of a heterodimeric Fc. The IL-15 and IL-15Rα (sushi) may have a variable length Gly-Ser linker between the C-terminus and the N-terminus of the Fc region. Single-chain IL-15/Rα-Fc fusion or "scIL-15/Rα-Fc" (FIG. 21B) comprises IL-15Rα(sushi) fused to IL-15 by a variable length linker (termed a "single-chain" IL-15/IL-15Rα(sushi) complex or "scIL-15/Rα") which is then fused to the N-terminus of a heterodimeric Fc-region, with the other side of the molecule being "Fc-only" or "empty Fc". Non-covalent IL-15/Rα-Fc or "ncIL-15/Rα-Fc" (FIG. 21C) comprises IL-15Rα(sushi) fused to a heterodimeric Fc region, while IL-15 is transfected separately so that a non-covalent IL-15/Rα complex is formed, with the other side of the molecule being "Fc-only" or "empty Fc". Bivalent non-covalent IL-15/Rα-Fc fusion or "bivalent ncIL-15/Rα-Fc" (FIG. 21D) comprises IL-15Rα(sushi) fused to the N-terminus of a homodimeric Fc region, while IL-15 is transfected separately so that a non-covalent IL-15/Rα complex is formed. Bivalent single-chain IL-15/Rα-Fc fusion or "bivalent scIL-15/Rα-Fc" (FIG. 21E) comprises IL-15 fused to IL-15Rα(sushi) by a variable length linker (termed a "single-chain" IL-15/IL-15Rα(sushi) complex or "scIL-15/Rα") which is then fused to the N-terminus of a homodimeric Fc-region. Fc-non-covalent IL-15/Rα fusion or "Fc-ncIL-15/Rα" (FIG. 21F) comprises IL-15Rα(sushi) fused to the C-terminus of a heterodimeric Fc region, while IL-15 is transfected separately so that a non-covalent IL-15/Rα complex is formed, with the other side of the molecule being "Fc-only" or "empty Fc". Fc-single-chain IL-15/Rα fusion or "Fc-scIL-15/Rα" (FIG. 21G) comprises IL-15 fused to IL-15Rα(sushi) by a variable length linker (termed a "single-chain" IL-15/IL-15Rα(sushi) complex or "scIL-15/Rα") which is then fused to the C-terminus of a heterodimeric Fc region, with the other side of the molecule being "Fc-only" or "empty Fc".

FIG. 22 depicts sequences of XENP20818 and XENP21475, illustrative IL-15/Rα-Fc fusion proteins of the "IL-15/Rα-heteroFc" format, with additional sequences being listed as XENPs 20819, 21471, 21472, 21473, 21474, 21476, and 21477 in the Figures. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 23 depicts sequences of XENP21478, an illustrative IL-15/Rα-Fc fusion protein of the "scIL-15/Rα-Fc" format, with additional sequences being listed as SEQ ID NOs: XXX-YYY (include XENPs 21993, 21994, 21995, 23174, 23175, 24477, and 24480). IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 24 depicts sequences of XENP21479, XENP22366 and XENP24348, illustrative IL-15/Rα-Fc fusion proteins of the "ncIL-15/Rα-Fc" format. IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 25 depicts sequences of XENP21978, an illustrative IL-15/Rα-Fc fusion protein of the "bivalent ncIL-15/Rα-Fc" format, with additional sequences being listed as SEQ ID NOs: XXX-YYY (include XENP21979). IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 26 depicts sequences of an illustrative IL-15/Rα-Fc fusion protein of the "bivalent scIL-15/Rα-Fc" format. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 27 depicts sequences of XENP22637, an illustrative IL-15/Rα-Fc fusion protein of the "Fc-ncIL-15/Rα" format, with additional sequences being listed as SEQ ID NOs: XXX-YYY (include XENP22638). IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 28 depicts sequences of an illustrative IL-15/Rα-Fc fusion protein of the "Fc-scIL-15/Rα" format. IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

Figure 29A:
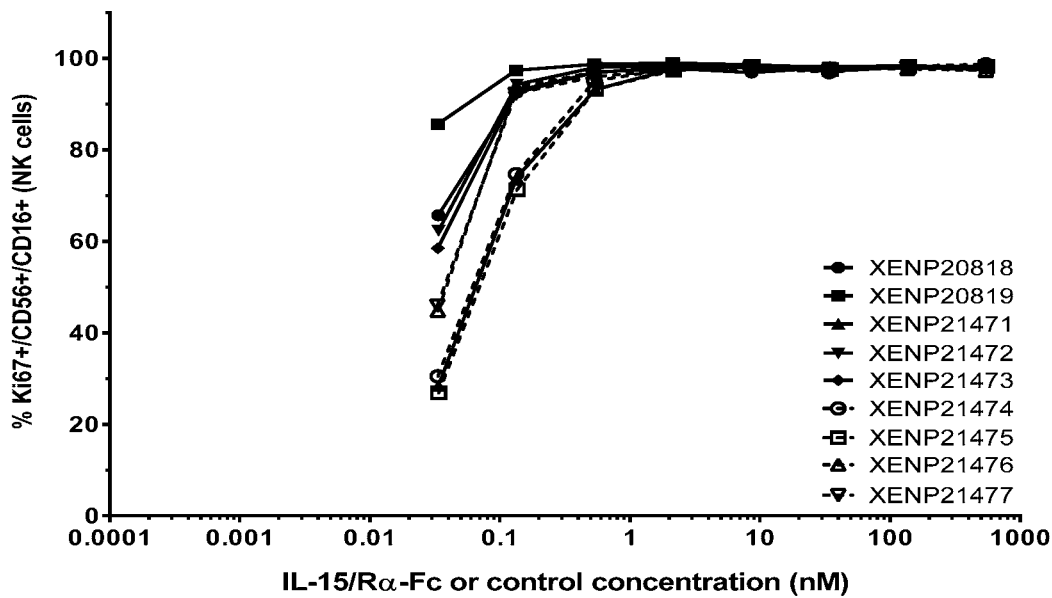
Figure 29B:
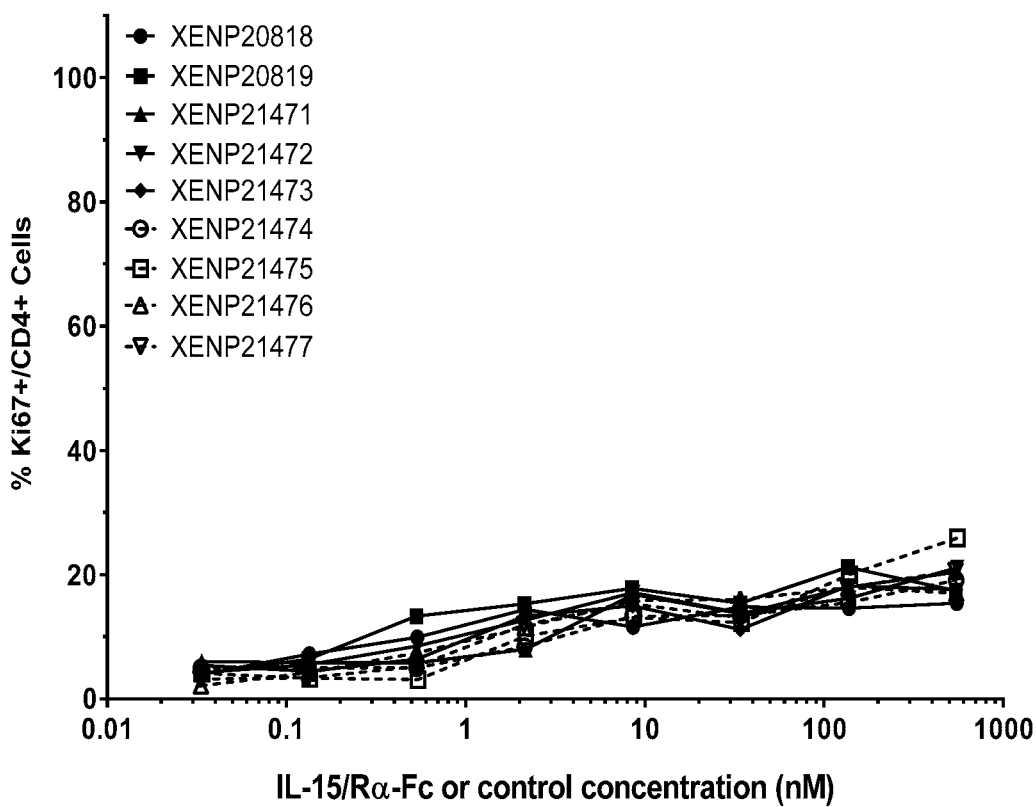
Figure 29C:
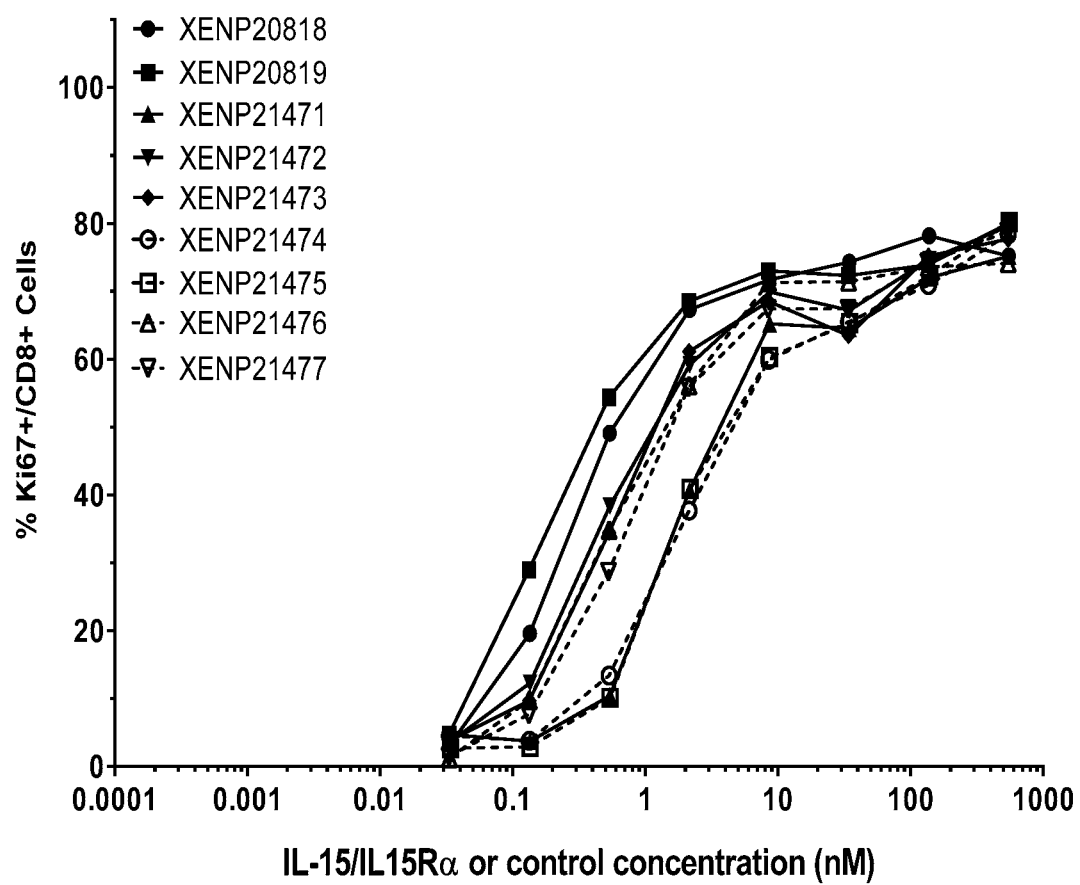

FIG. 29A-29C depicts the induction of A) NK (CD56$^+$/CD16$^+$) cells, B) CD4$^+$ T cells, and C) CD8$^+$ T cells proliferation by illustrative IL-15/Rα-Fc fusion proteins of Format A with different linker lengths based on Ki67 expression as measured by FACS.

Figure 30A:
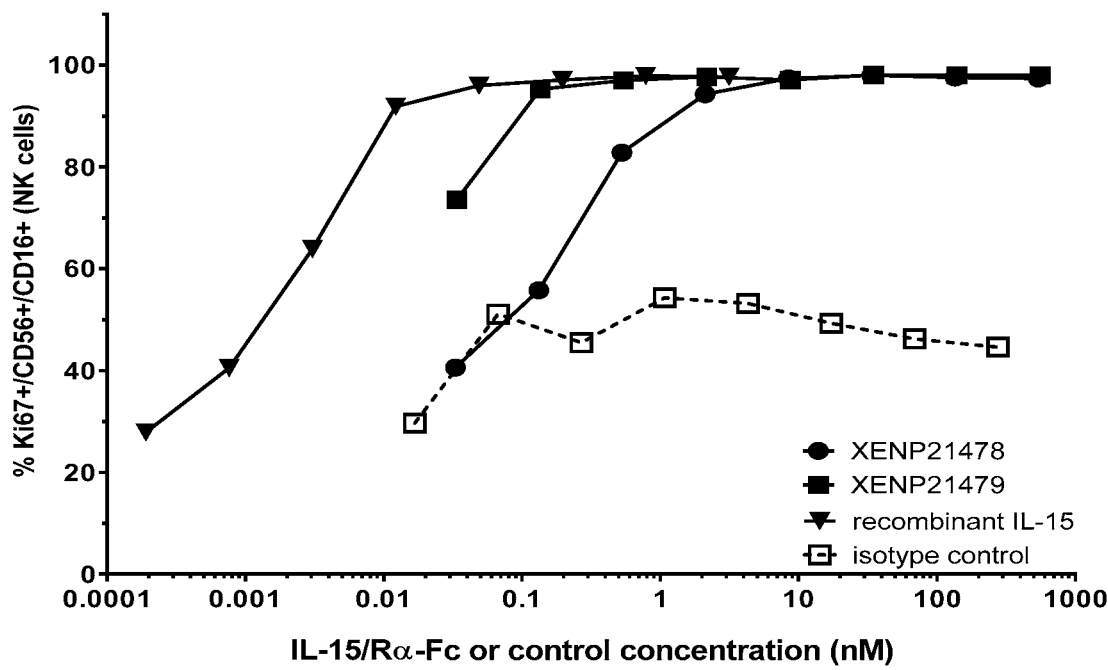
Figure 30B:
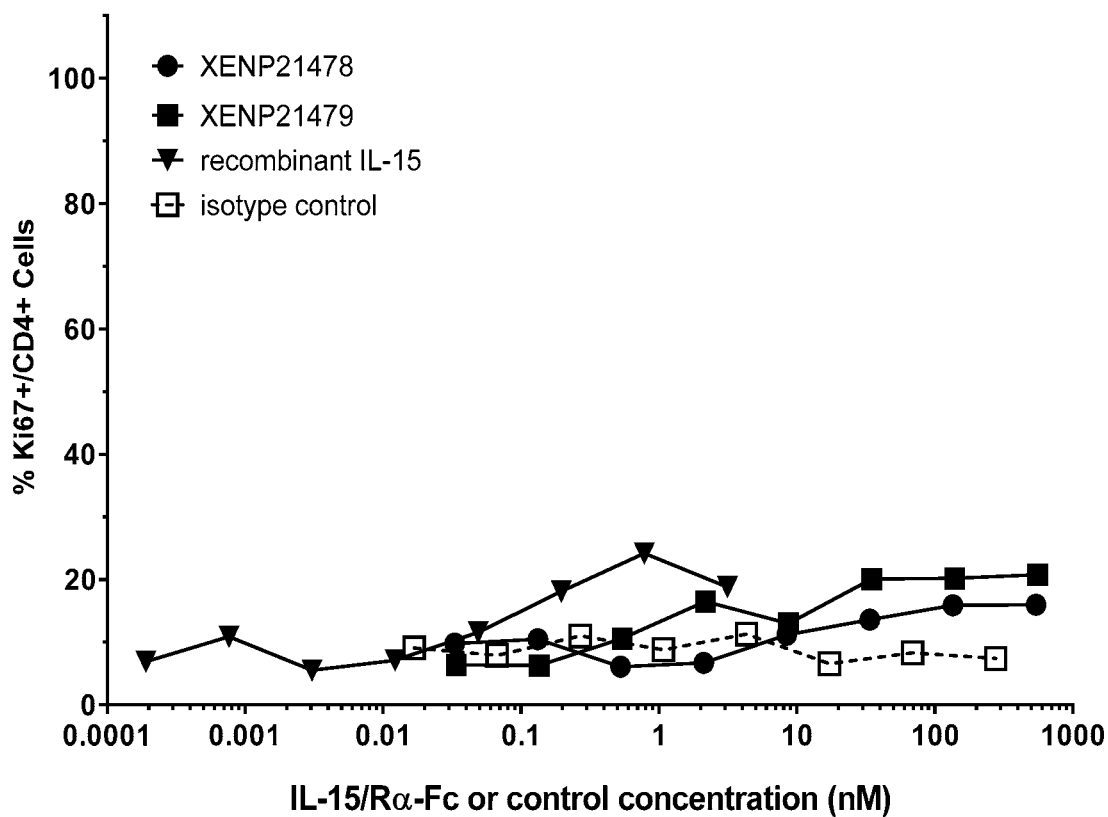
Figure 30C:
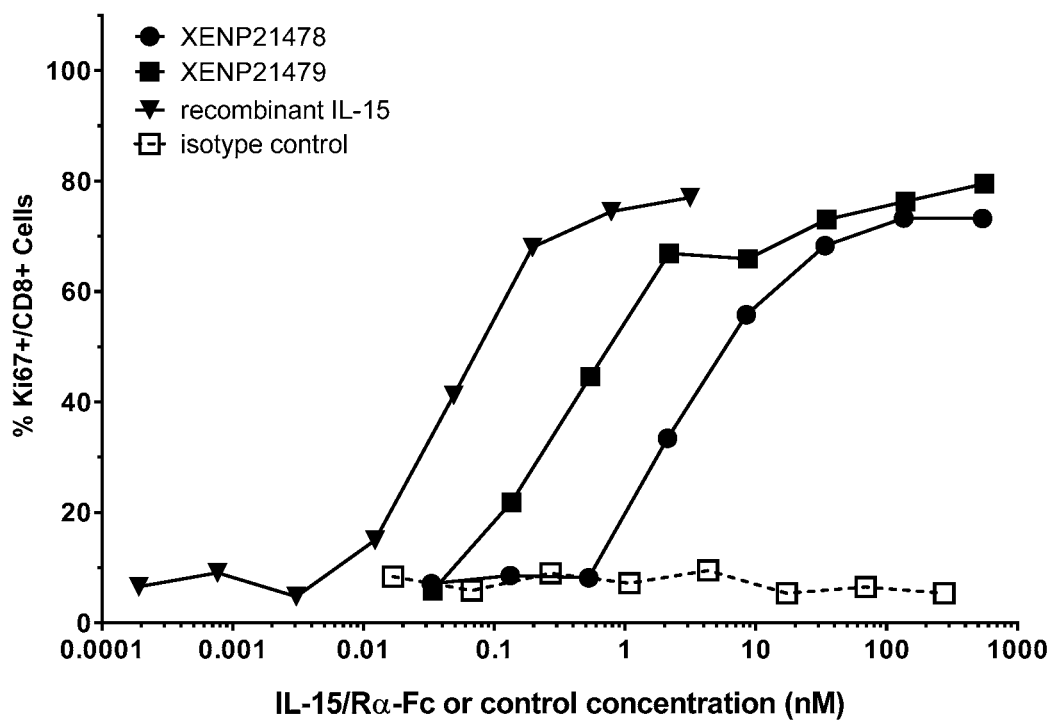

FIG. 30A-30C depicts the induction of A) NK (CD56$^+$/CD16$^+$) cells, B) CD4$^+$ T cells, and C) CD8$^+$ T cells proliferation by illustrative IL-15/Rα-Fc fusion proteins of scIL-15/Rα-Fc format (XENP21478) and ncIL-15/Rα-Fc format (XENP21479) based on Ki67 expression as measured by FACS.

Figure 31:
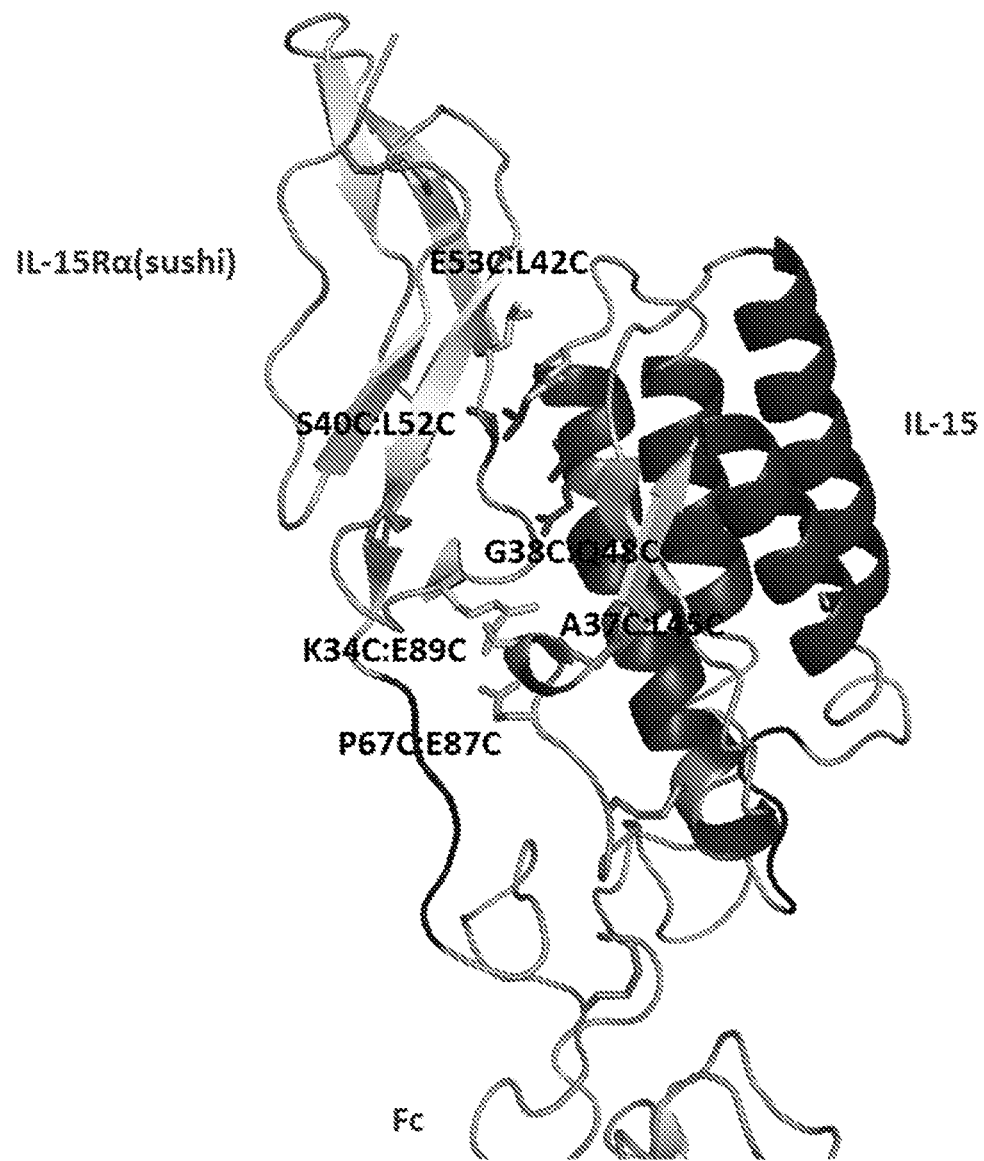
Figure 35A:
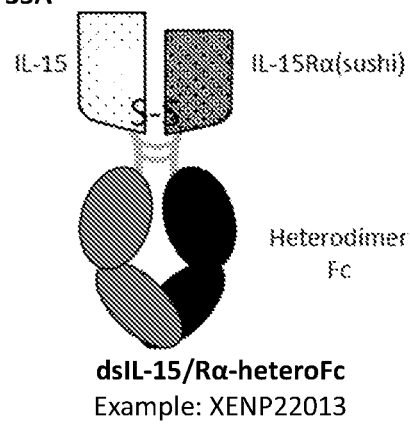
Figure 35B:
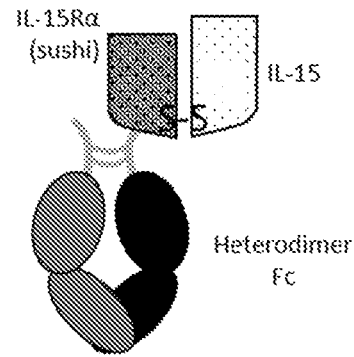
Figure 35C:
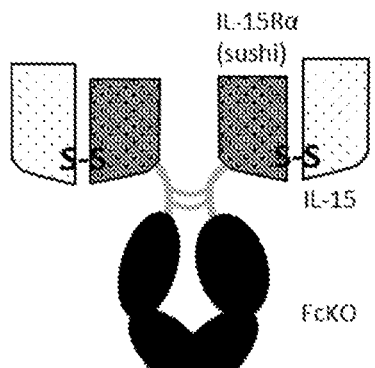
Figure 35D:
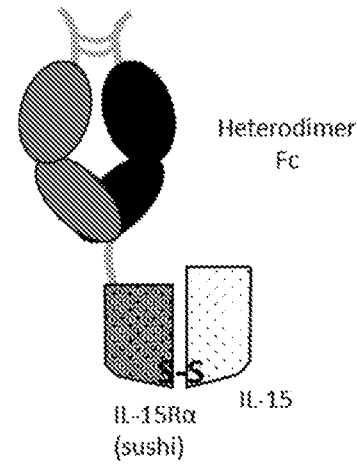

FIG. 31 depicts a structural model of the IL-15/Rα heterodimer showing locations of engineered disulfide bond pairs.

FIG. 32 depicts sequences for illustrative IL-15Rα(sushi) variants engineered with additional residues at the C-terminus to serve as a scaffold for engineering cysteine residues.

FIG. 33 depicts sequences for illustrative IL-15 variants engineered with cysteines in order to form covalent disulfide bonds with IL-15Rα(sushi) variants engineered with cysteines.

FIG. 34 depicts sequences for illustrative IL-15Rα(sushi) variants engineered with cysteines in order to form covalent disulfide bonds with IL-15 variants engineered with cysteines.

FIG. 35A-35D depicts additional formats for the IL-15/Rα-Fc fusion proteins of the present invention with engineered disulfide bonds. Disulfide-bonded IL-15/Rα heterodimeric Fc fusion or "dsIL-15/Rα-heteroFc" (FIG. 35A) is the same as "IL-15/Rα-heteroFc", but wherein IL-15Rα (sushi) and IL-15 are further covalently linked as a result of engineered cysteines. Disulfide-bonded IL-15/Rα Fc fusion or "dsIL-15/Rα-Fc" (FIG. 35B) is the same as "ncIL-15/Rα-Fc", but wherein IL-15Rα(sushi) and IL-15 are further covalently linked as a result of engineered cysteines. Bivalent disulfide-bonded IL-15/Rα-Fc or "bivalent dsIL-15/Rα-Fc" (FIG. 35C) is the same as "bivalent ncIL-15/Rα-Fc", but wherein IL-15Rα(sushi) and IL-15 are further covalently linked as a result of engineered cysteines. Fc-disulfide-bonded IL-15/Rα fusion or "Fc-dsIL-15/Rα" (FIG. 35D) is the same as "Fc-ncIL-15/Rα", but wherein IL-15Rα(sushi) and IL-15 are further covalently linked as a result of engineered cysteines.

FIG. 36A-36B depicts sequences of XENP22013, XENP22014, XENP22015, and XENP22017, illustrative IL-15/Rα-Fc fusion protein of the "dsIL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 37A-37B depicts sequences of XENP22357, XENP22358, XENP22359, XENP22684, and XENP22361, illustrative IL-15/Rα-Fc fusion proteins of the "dsIL-15/Rα-Fc" format. Additional sequences are depicted XENPs 22360, 22362, 22363, 22364, 22365, and 22366). IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 38 depicts sequences of XENP22634, XENP22635, and XENP22636, illustrative IL-15/Rα-Fc fusion proteins of the "bivalent dsIL-15/Rα-Fc" format. Additional sequences are depicted as SEQ ID NOs: XXX-YYY (include XENP22687). IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 39 depicts sequences of XENP22639 and XENP22640, illustrative IL-15/Rα-Fc fusion proteins of the "Fc-dsIL-15/Rα" format. IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

Figure 40:
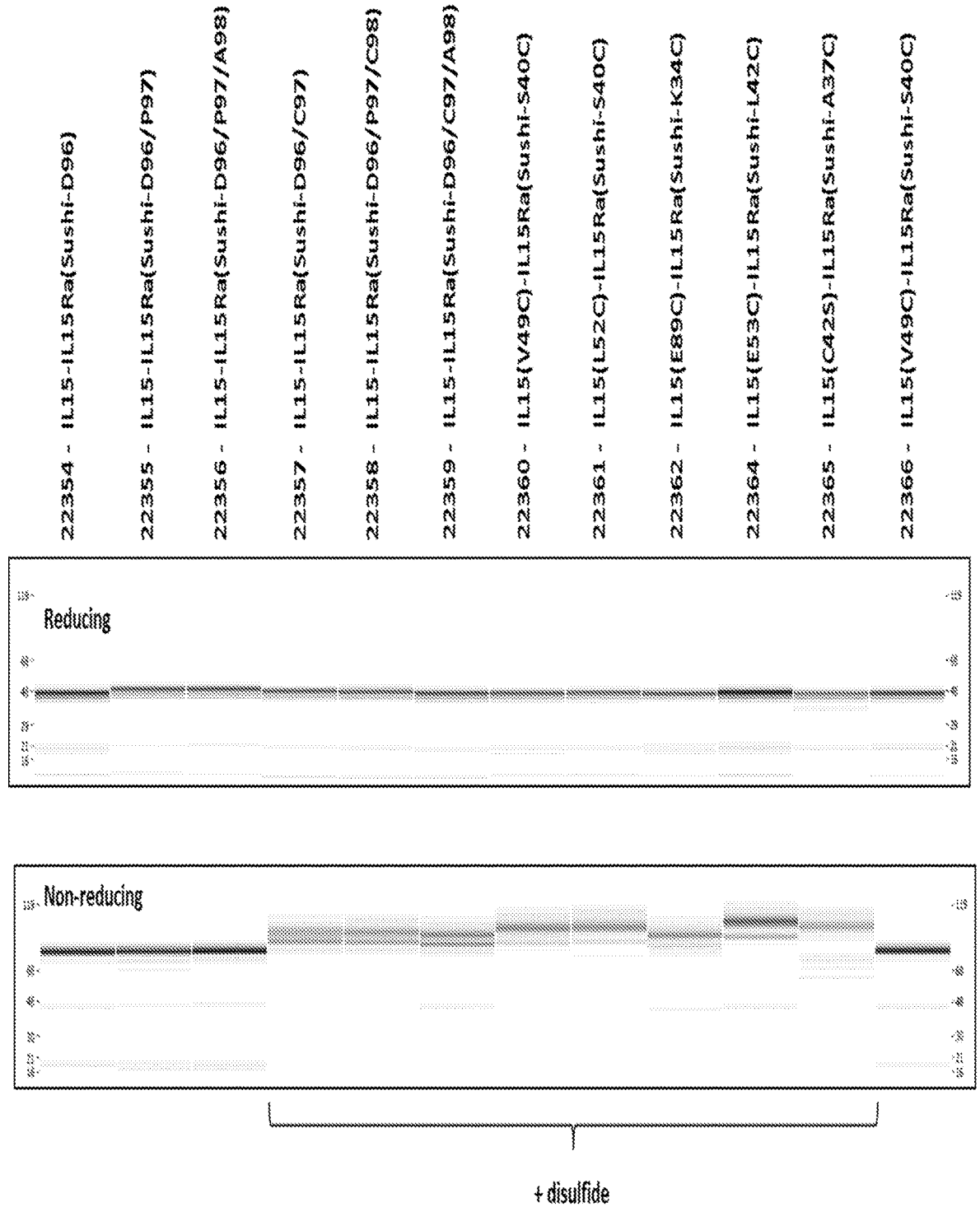

FIG. 40 depicts the purity and homogeneity of illustrative IL-15/Rα-Fc fusion proteins with and without engineered disulfide bonds as determined by CEF.

Figure 41A:
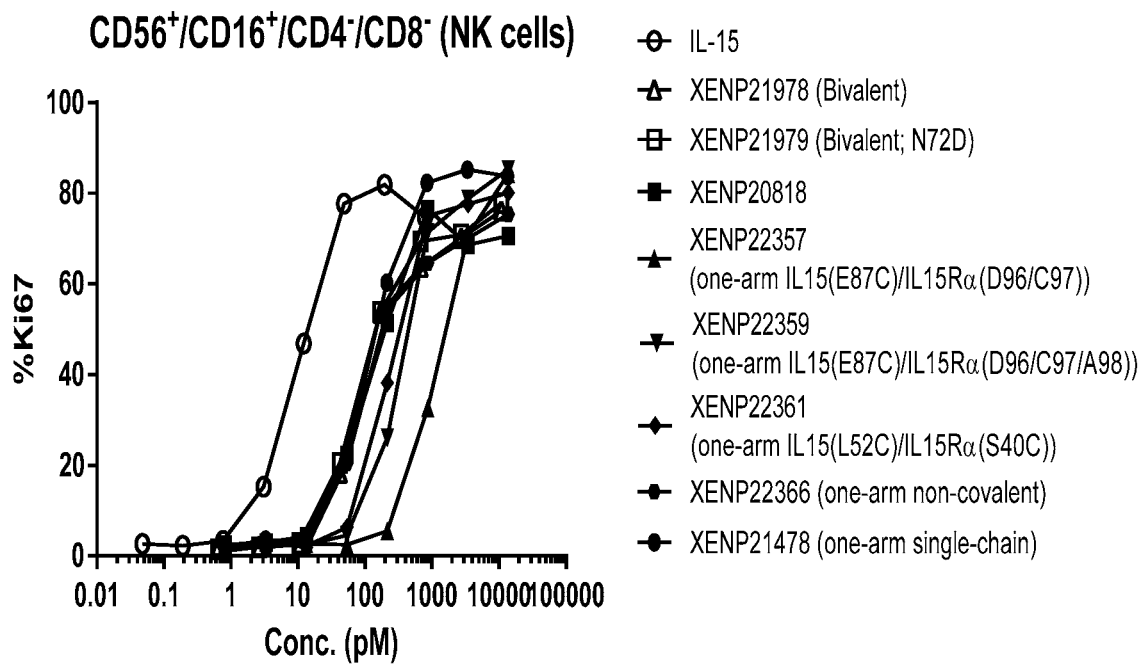
Figure 41B:
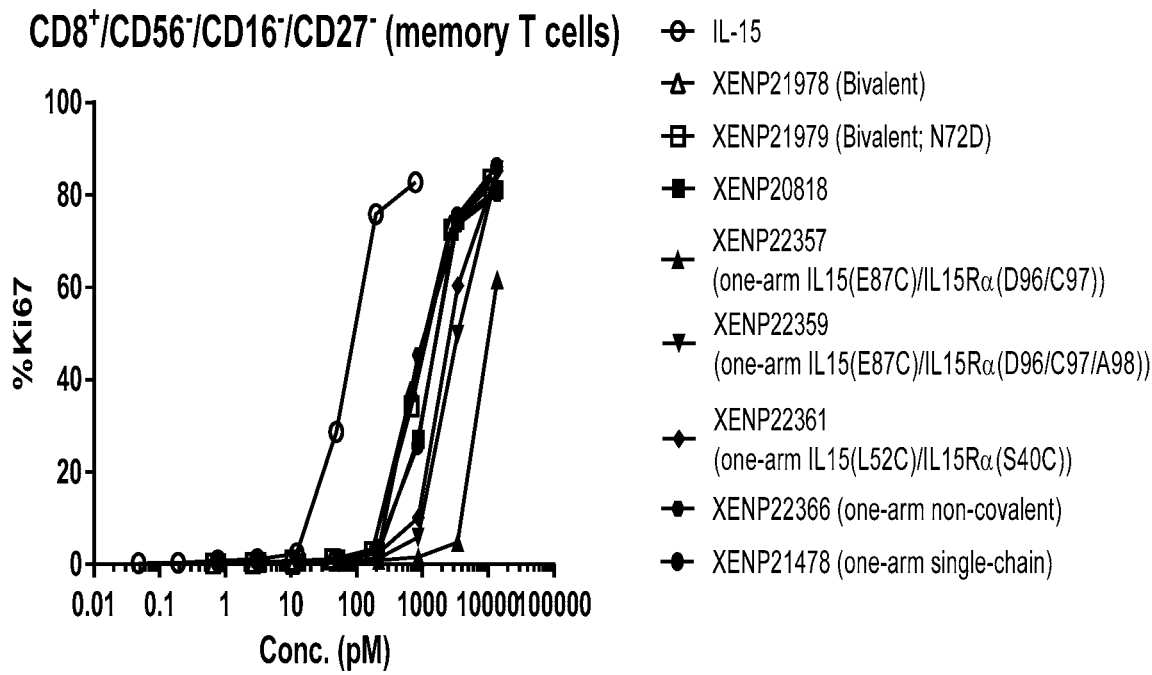
Figure 41C:
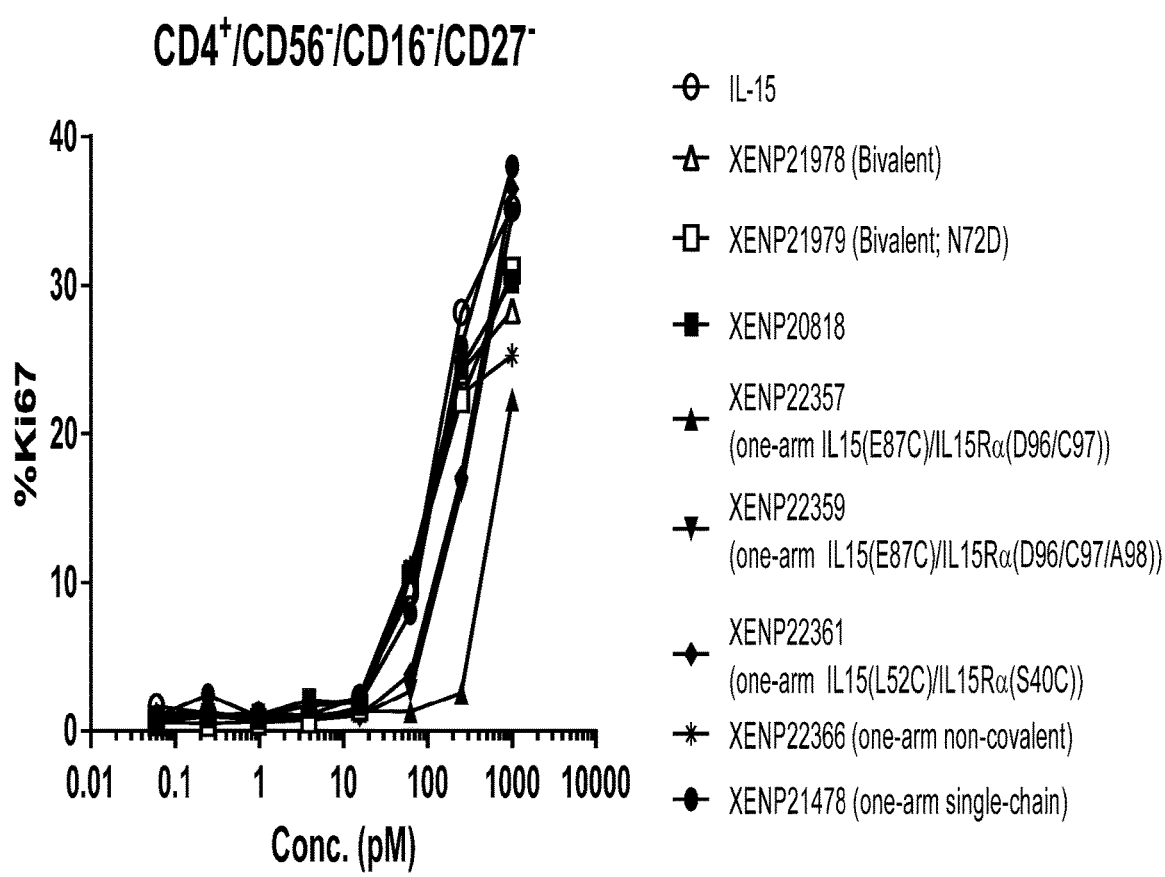

FIG. 41A-41C depicts the induction of A) NK (CD56+/CD16+) cell, B) CD8+ T cell, and C) CD4+ T cell proliferation by illustrative IL-15/Rα-Fc fusion proteins with and without engineered disulfide bonds based on Ki67 expression as measured by FACS.

Figure 42:
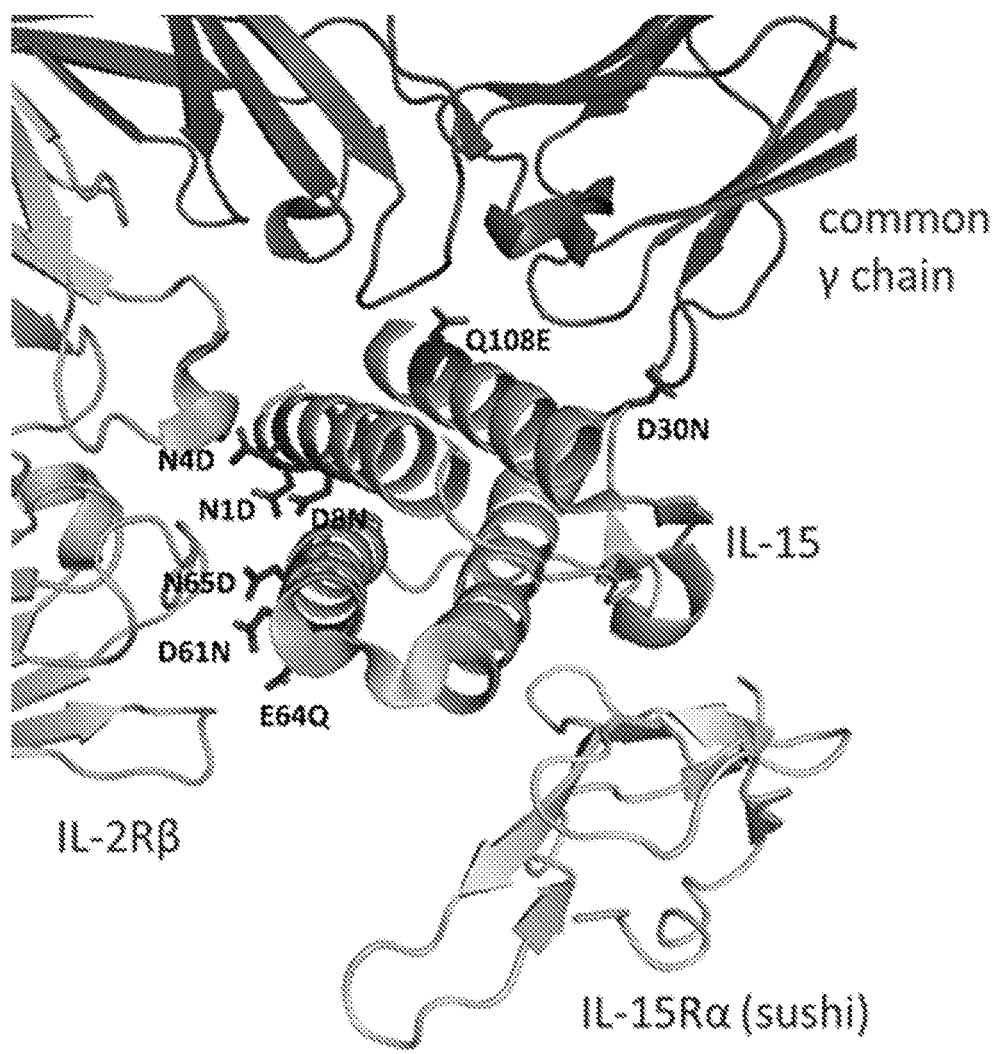

FIG. 42 depicts the structure of IL-15 complexed with IL-15Rα, IL-2Rβ, and common gamma chain. Locations of substitutions designed to reduce potency are shown.

FIG. 43A-43C depicts sequences for illustrative IL-15 variants engineered for reduced potency. Included within each of these variant IL-15 sequences are sequences that are 90, 95, 98 and 99% identical (as defined herein) to the recited sequences, and/or contain from 1, 2, 3, 4, 5, 6, 7, 8, 9 or 10 additional amino acid substitutions. In a non-limiting example, the recited sequences may contain additional amino acid modifications such as those contributing to formation of covalent disulfide bonds as described in Example 3B.

FIG. 44A-44D depicts sequences of XENP22821, XENP22822, XENP23554, XENP23557, XENP23561, XENP24018, XENP24019, XENP24045, XENP24051, and XENP24052, illustrative IL-15/Rα-Fc fusion proteins of the "IL-15/Rα-heteroFc" format engineered for reduced potency. Additional sequences are depicted as SEQ ID NOs: XXX-YYY (include XENPs 22815, 22816, 22817, 22818, 22819, 22820, 22823, 22824, 22825, 22826, 22827, 22828, 22829, 22830, 22831, 22832, 22833, 22834, 23555, 23559, 23560, 24017, 24020, 24043, and 24048). IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 45A-45C depicts sequences of XENP24015, XENP24050, XENP24475, XENP24476, XENP24478, XENP24479, and XENP24481, illustrative IL-15/Rα-Fc fusion proteins of the "scIL-15/Rα-Fc" format engineered for reduced potency. Additional sequences are depicted as SEQ ID NOs: XXX-YYY (include XENPs 24013, 24014, and 24016). IL-15 and IL-15Rα(sushi) are underlined, linkers are double underlined (although as will be appreciated by those in the art, the linkers can be replaced by other linkers, some of which are depicted in FIG. 8, and slashes (/) indicate the border(s) between IL-15, IL-15Rα, linkers, and Fc regions.

FIG. 46A-46B depicts sequences of XENP24349, XENP24890, and XENP25138, illustrative IL-15/Rα-Fc fusion proteins of the "ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 47 depicts sequences of XENP22801 and XENP22802, illustrative ncIL-15/Rα heterodimers engineered for reduced potency. Additional sequences are depicted as SEQ ID NOs: XXX-YYY (XENPs 22791, 22792, 22793, 22794, 22795, 22796, 22803, 22804, 22805, 22806, 22807, 22808, 22809, 22810, 22811, 22812, 22813, and 22814). It is important to note that these sequences were generated using polyhistidine (His×6 or HHHHHH (SEQ ID NO: 6)) C-terminal tags at the C-terminus of IL-15Rα (sushi).

FIG. 48 depicts sequences of XENP24342, an illustrative IL-15/Rα-Fc fusion protein of the "bivalent ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

FIG. 49 depicts sequences of XENP23472 and XENP23473, illustrative IL-15/Rα-Fc fusion proteins of the "dsIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 8), and slashes (/) indicate the border(s) between IL-15, IL-15Rα, linkers, and Fc regions.

Figure 50A:
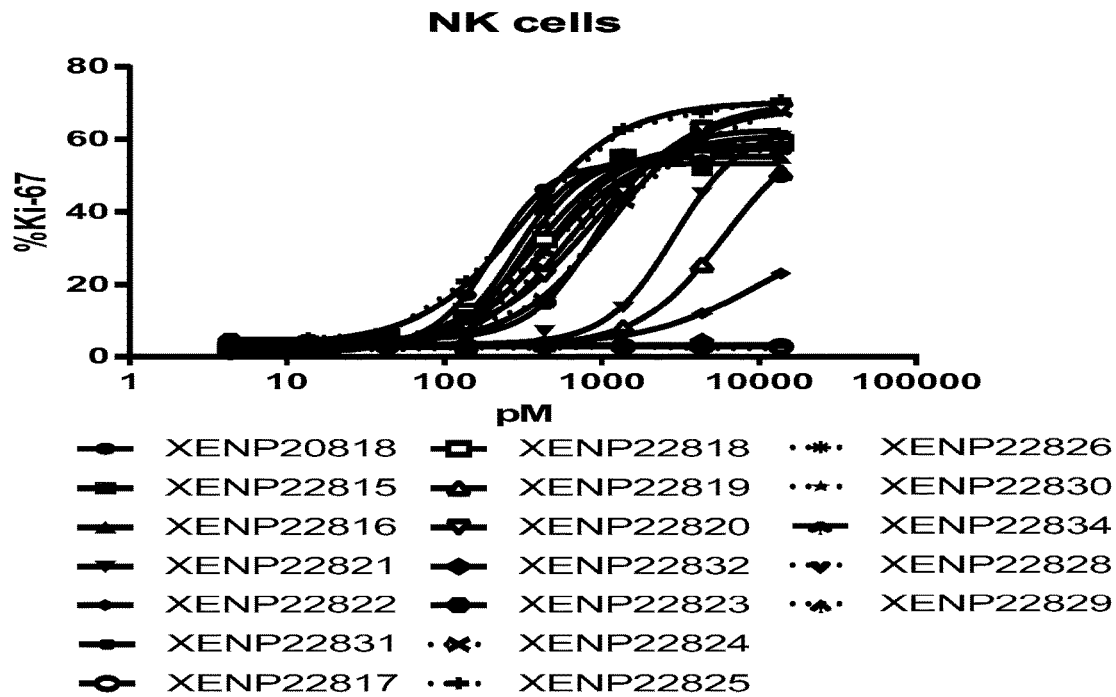
Figure 50B:
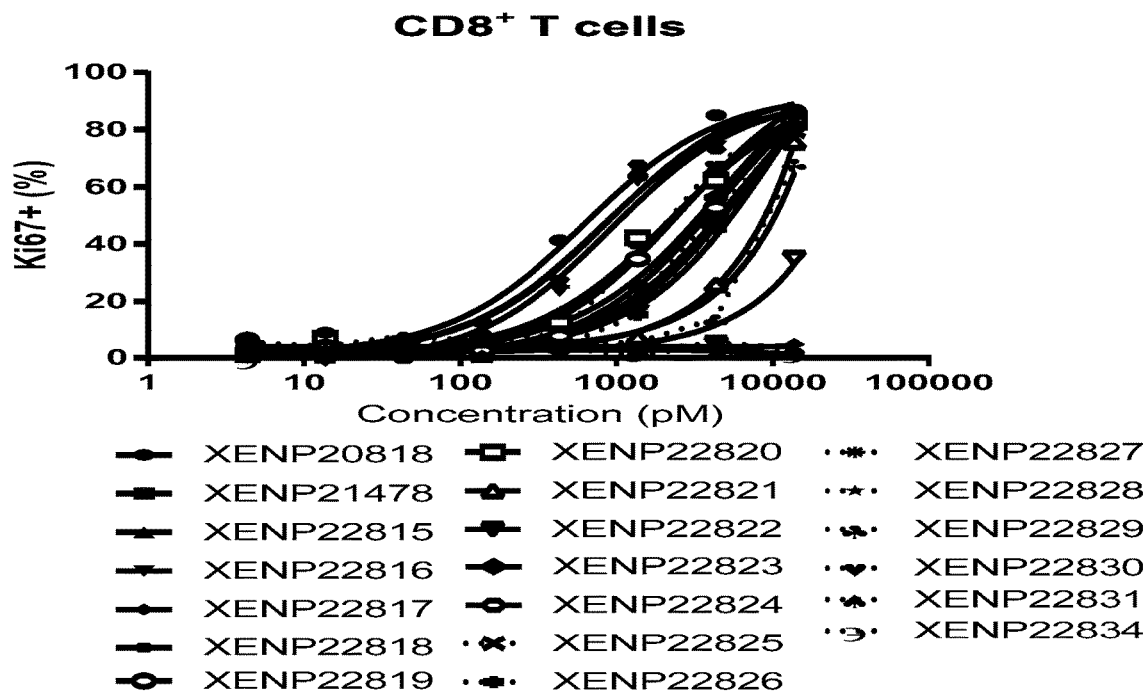
Figure 50C:
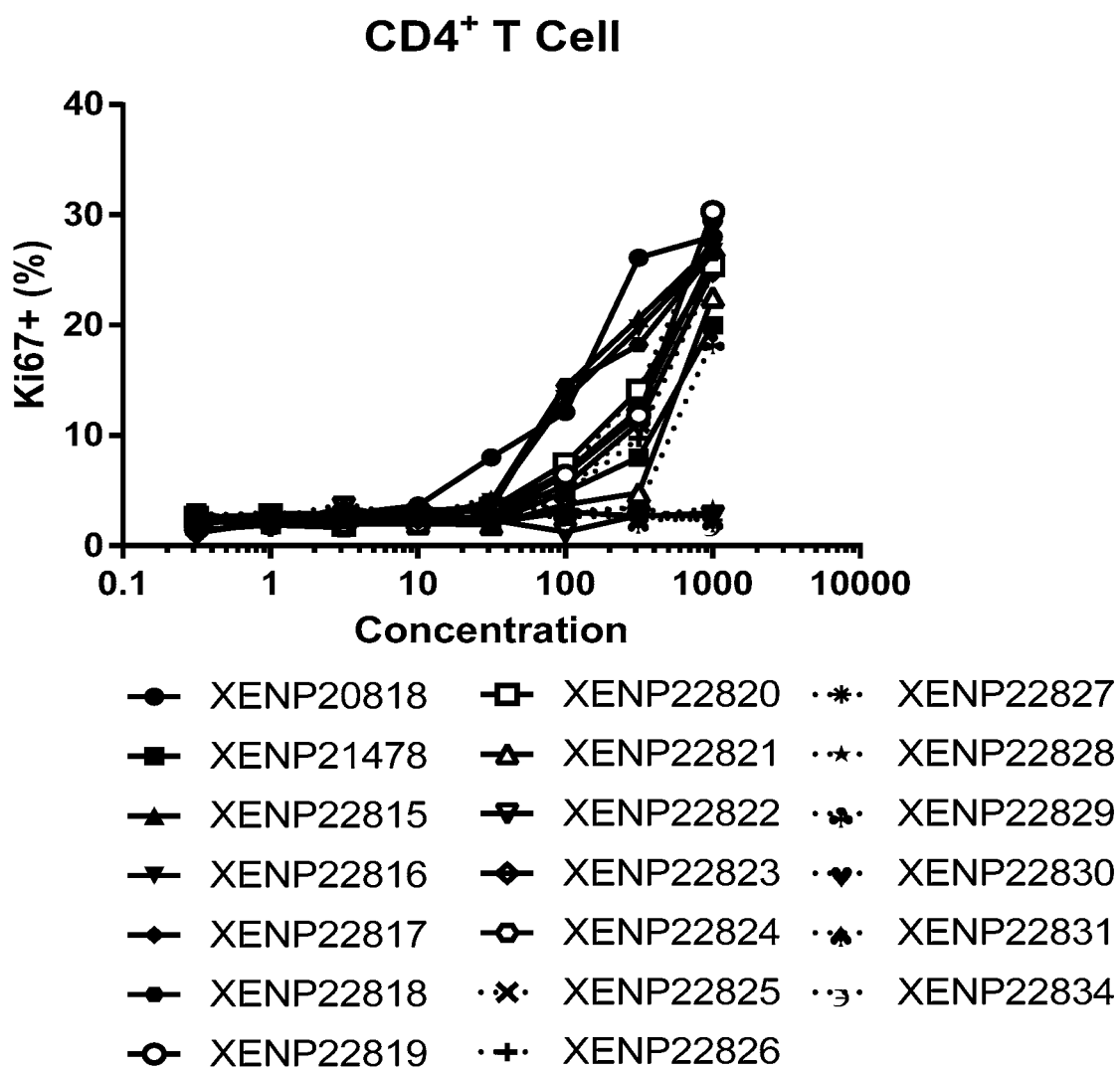

FIG. 50A-50C depicts the induction of A) NK cell, B) CD8+ (CD45RA−) T cell, and C) CD4+ (CD45RA−) T cell proliferation by variant IL-15/Rα-Fc fusion proteins based on Ki67 expression as measured by FACS.

FIG. 51 depicts EC50 for induction of NK and CD8+ T cells proliferation by variant IL-15/Rα-Fc fusion proteins, and fold reduction in EC50 relative to XENP20818.

Figure 52A:
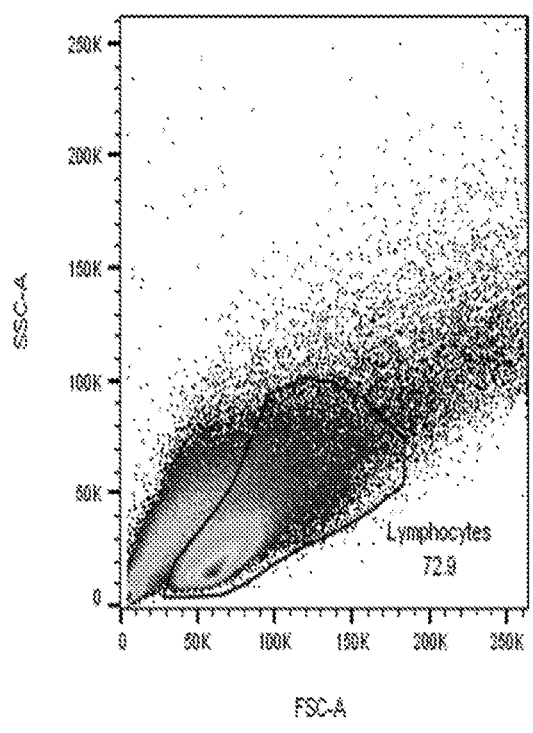
Figure 52B:
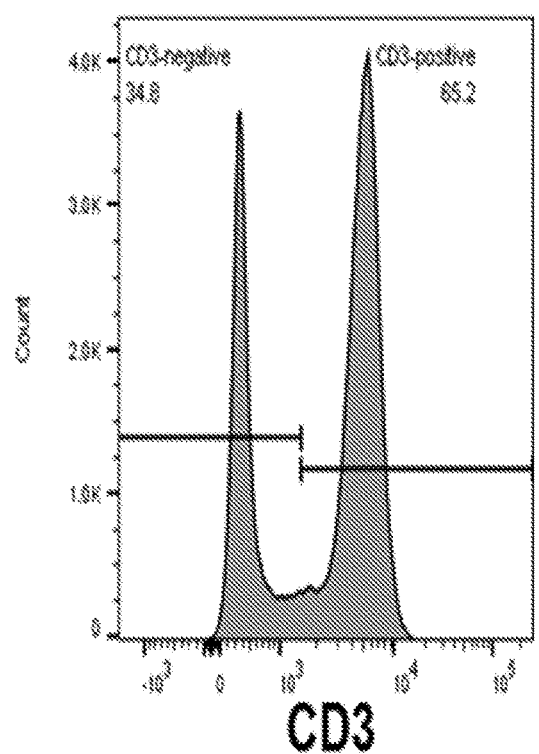
Figure 52C:
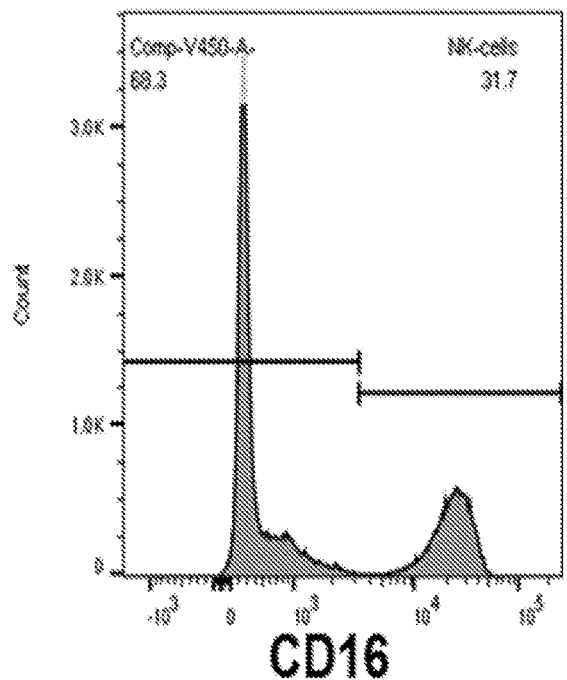

FIG. 52A-52C depicts the gating of lymphocytes and subpopulations for the experiments depicted in FIG. 51. FIG. 52A shows the gated lymphocyte population. FIG. 52B shows the CD3-negative and CD3-positive subpopulations. FIG. 52C shows the CD16=negative and CD16-positive subpopulations of the CD3-negative cells.

Figure 53A:
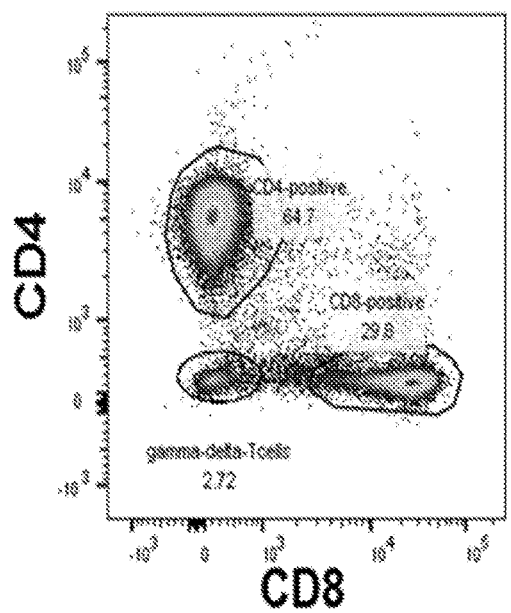
Figure 53B:
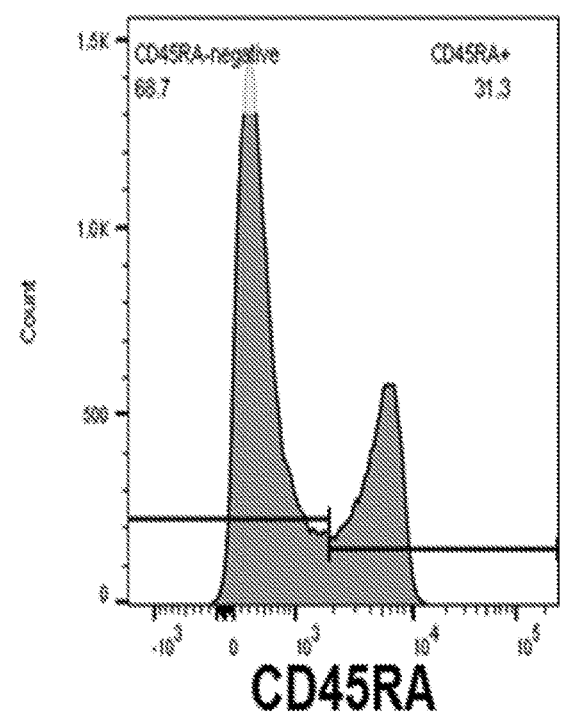
Figure 53C:
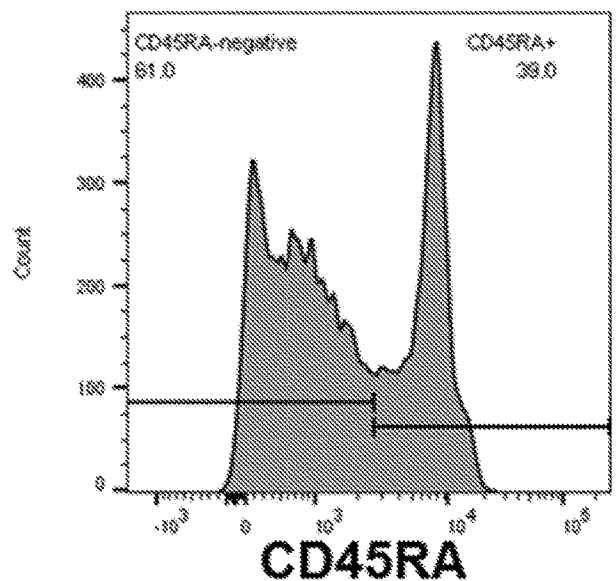

FIG. 53A-53C depicts the gating of CD3+ lymphocyte subpopulations for the experiments depicted in FIG. 51. FIG. 53A shows the CD4+, CD8+ and γδ T cell subpopulations of the CD3+ T cells. FIG. 53B shows the CD45RA(−) and CD45RA(+) subpopulations of the CD4+ T cells. FIG. 53C shows the CD45RA(−) and CD45RA(+) subpopulations of the CD8+ T cells.

Figure 54A:
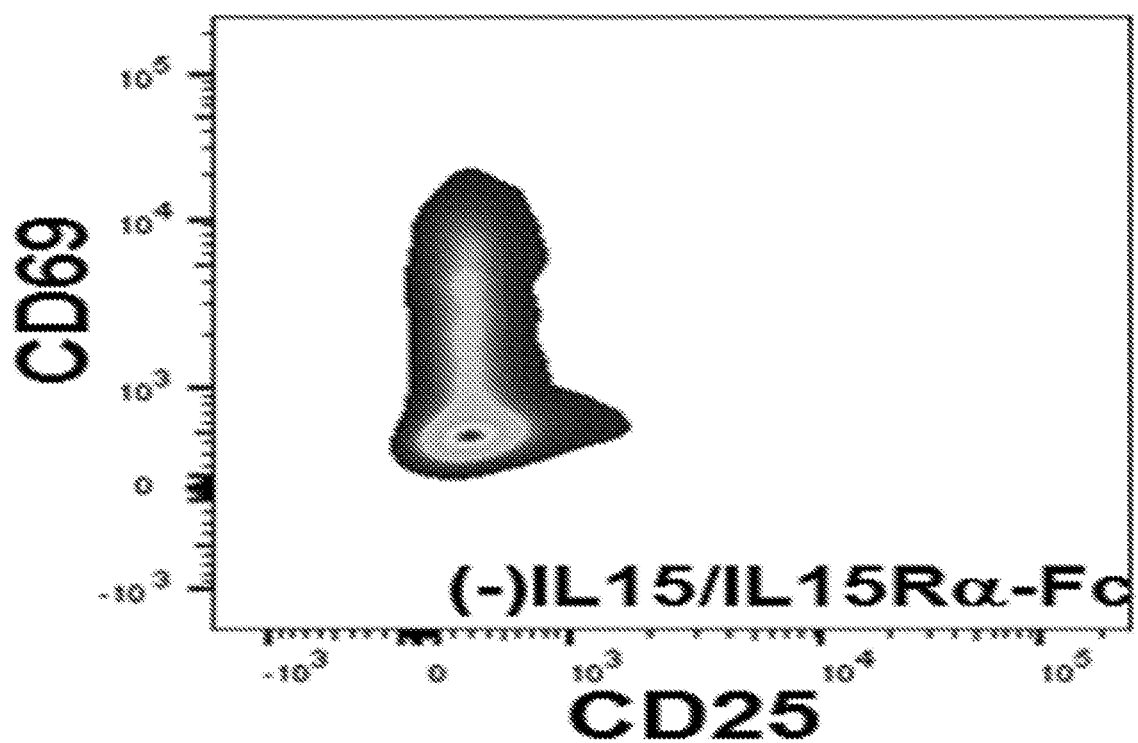
Figure 54B:
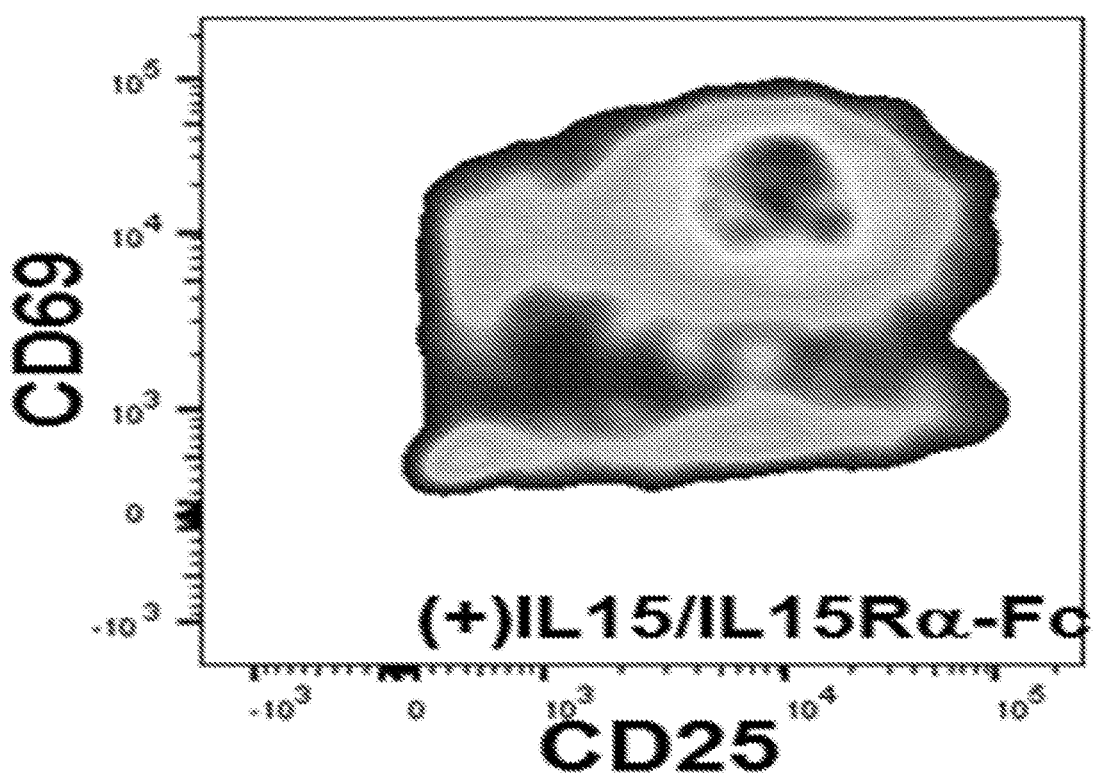

FIG. 54A-54B depicts CD69 and CD25 expression before (FIG. 54A) and after (FIG. 54B) incubation of human PBMCs with XENP22821

Figure 55A:
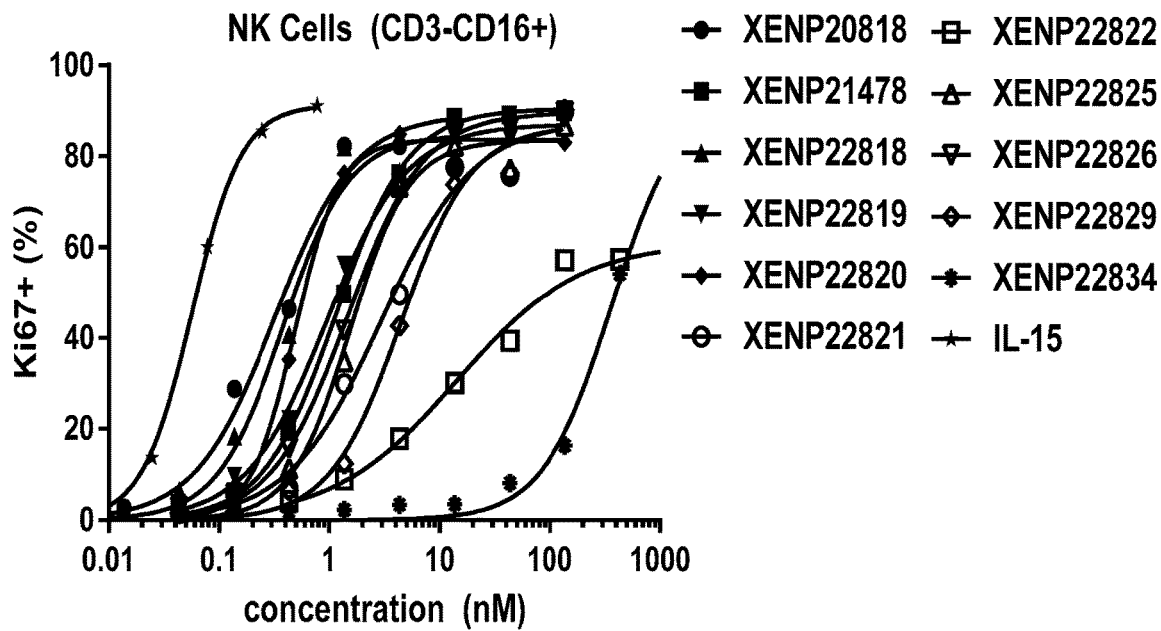
Figure 55B:
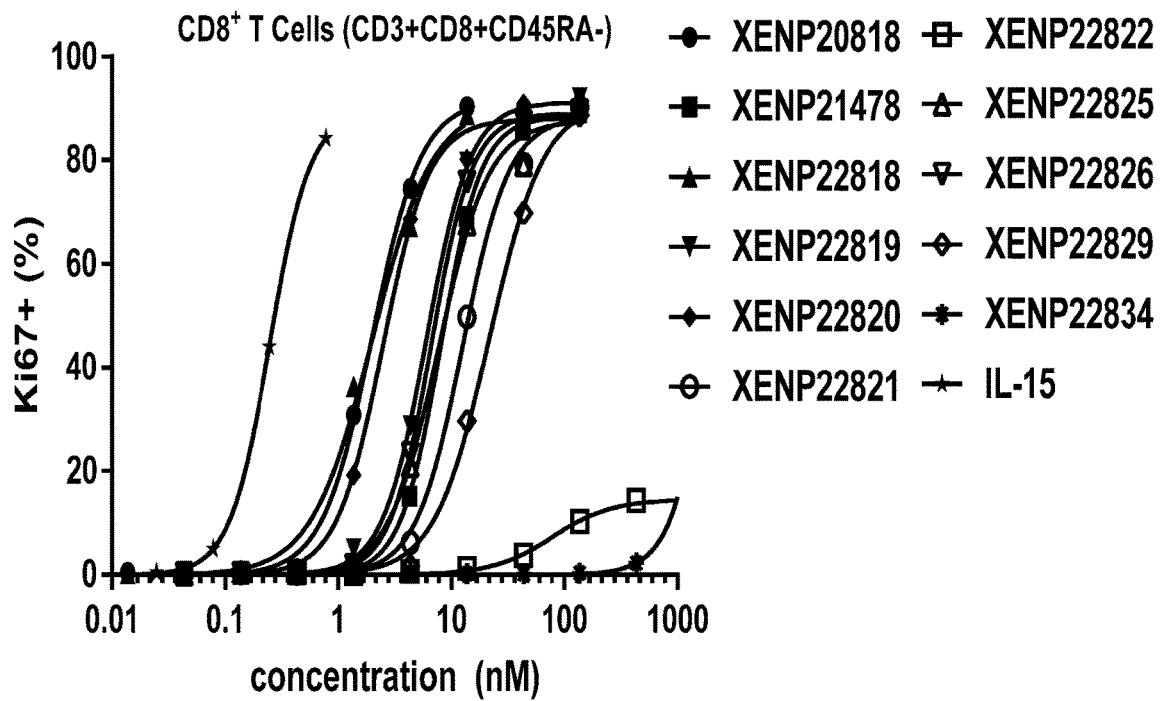
Figures 55C, 55D:
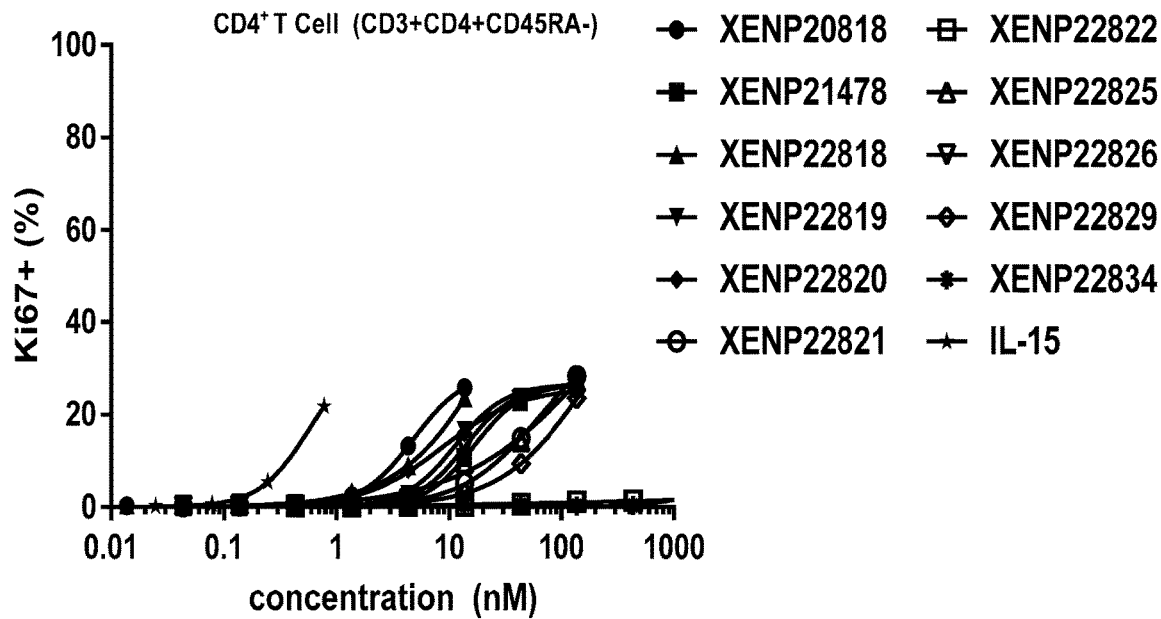

FIG. 55A-55D depict cell proliferation in human PBMCs incubated for four days with the indicated variant IL-15/Rα-Fc fusion proteins. FIGS. 55A-55D show the percentage of proliferating NK cells (CD3-CD16+) (FIG. 55A), CD8+ T cells (CD3+CD8+CD45RA−) (FIG. 55B) and CD4+ T cells (CD3+CD4+CD45RA−) (FIG. 55C). FIG. 55D shows the fold change in EC50 of various IL15/IL15Rα Fc heterodimers relative to control (XENP20818).

Figure 56A:
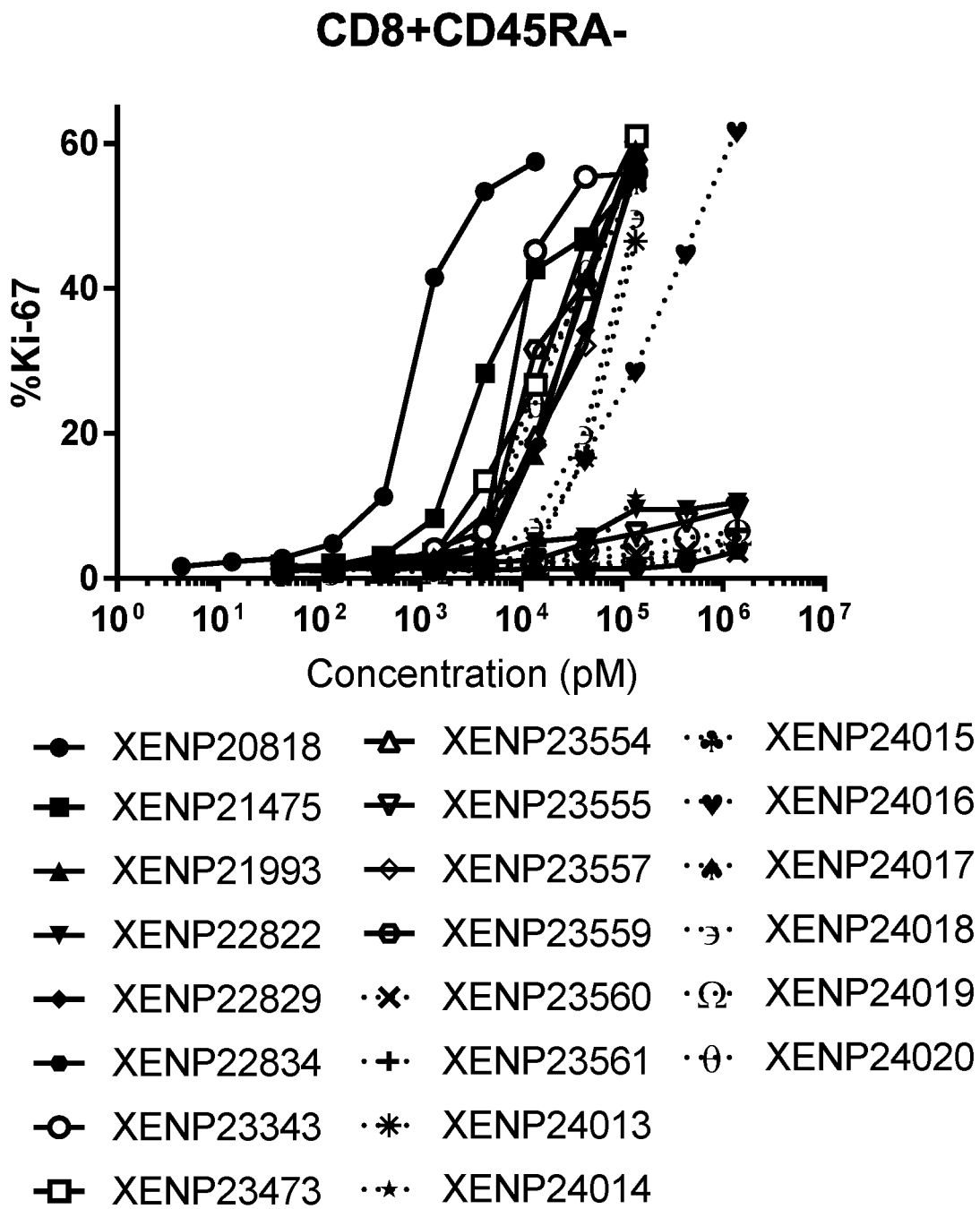
Figure 56B:
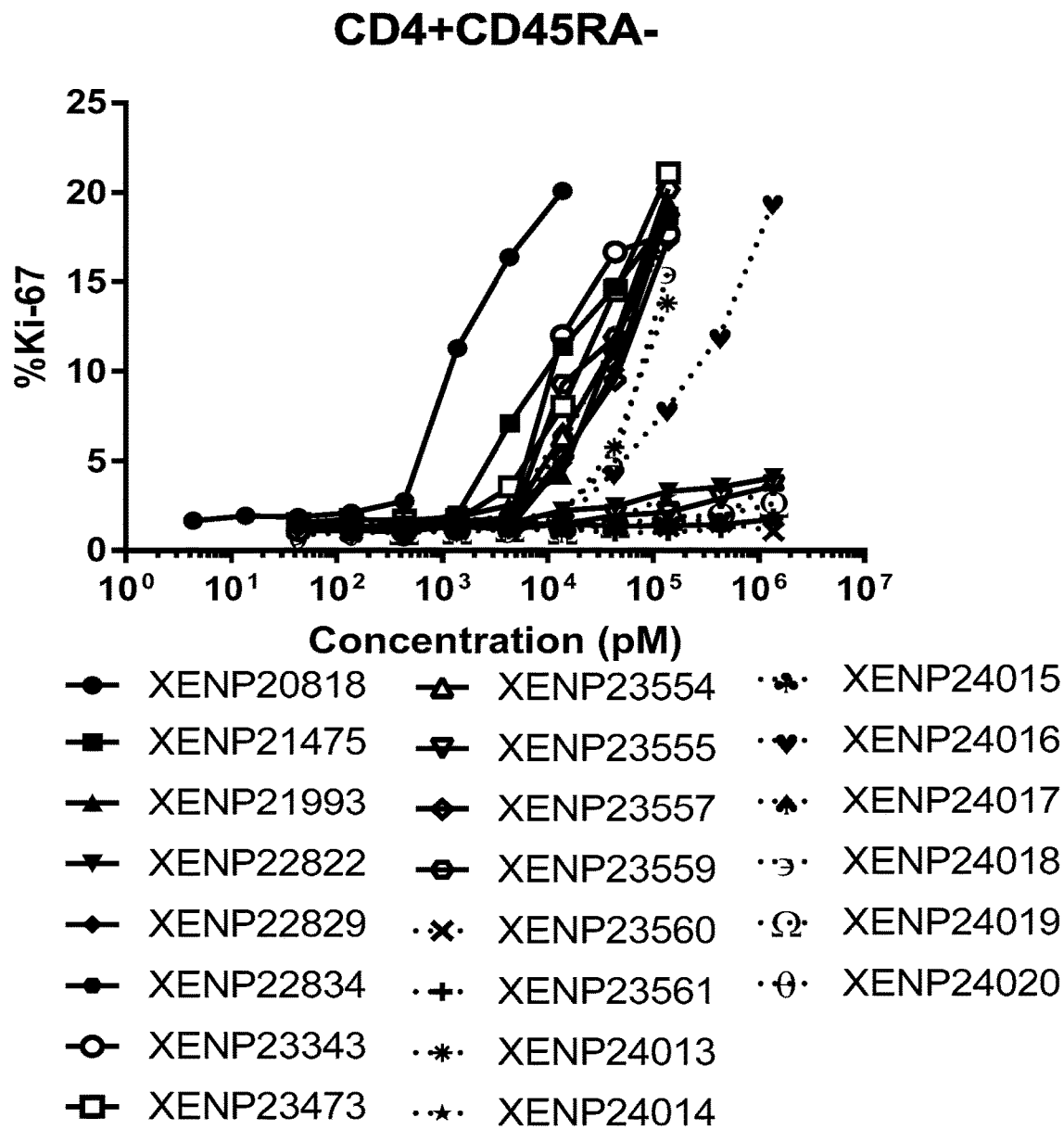
Figure 56C:
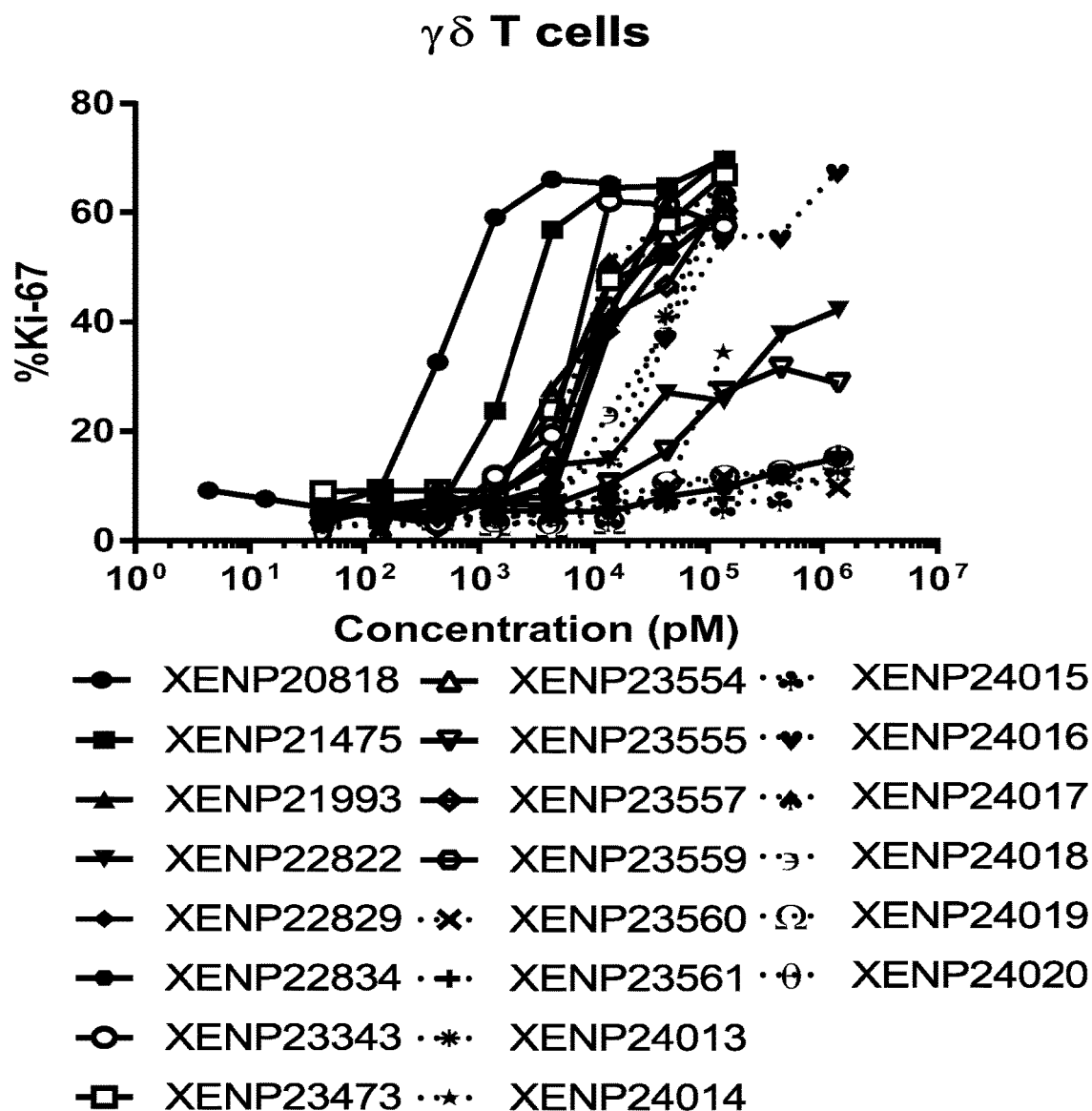
Figure 56D:
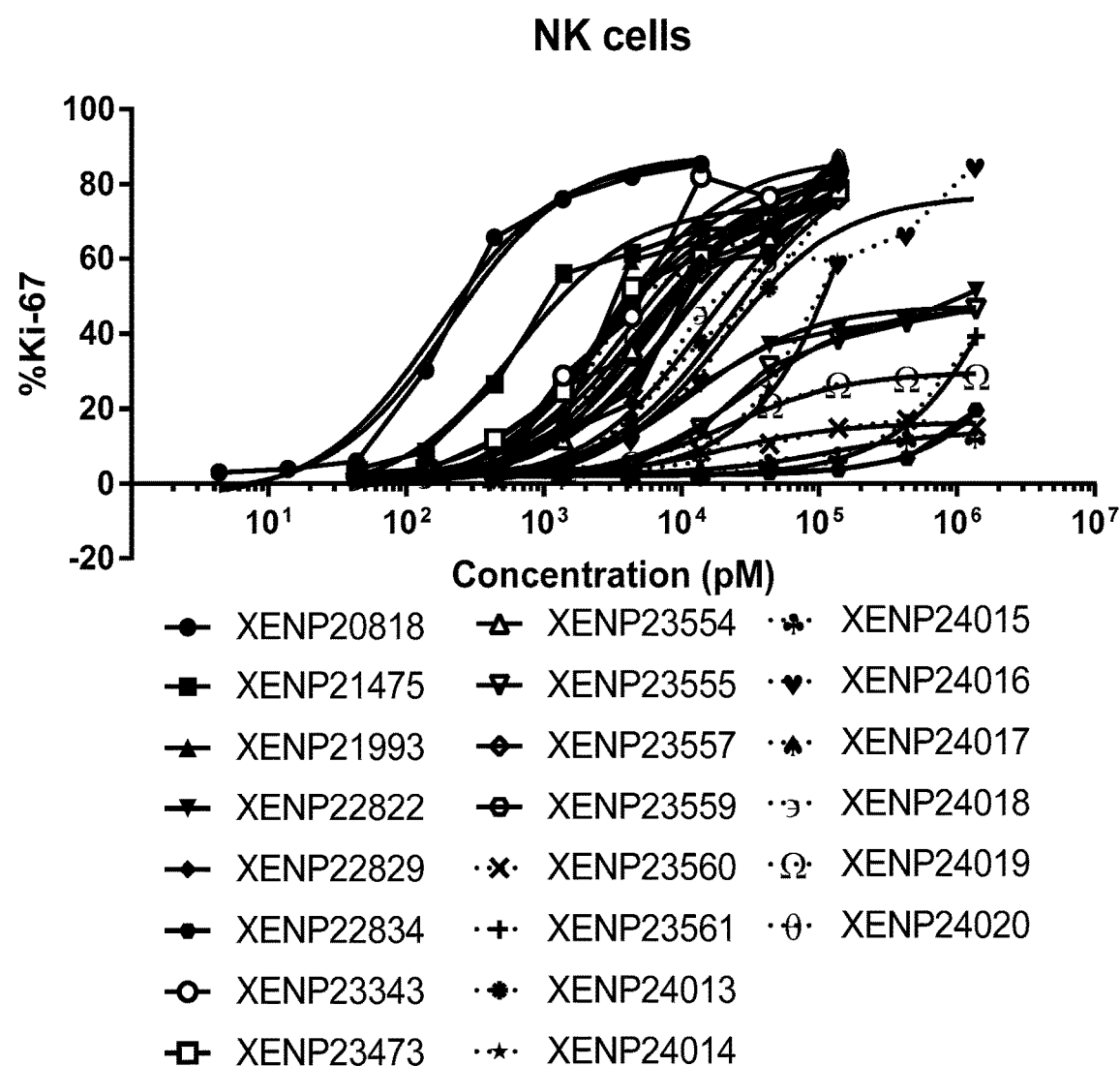

FIG. 56A-56D depict cell proliferation in human PBMCs incubated for three days with the indicated variant IL-15/Rα-Fc fusion proteins. FIGS. 56A-56D show the percentage of proliferating CD8+ (CD45RA−) T cells (FIG. 56A), CD4+ (CD45RA−) T cells (FIG. 56B), γδ T cells (FIG. 56C), and NK cells (FIG. 56D).

Figure 57A:
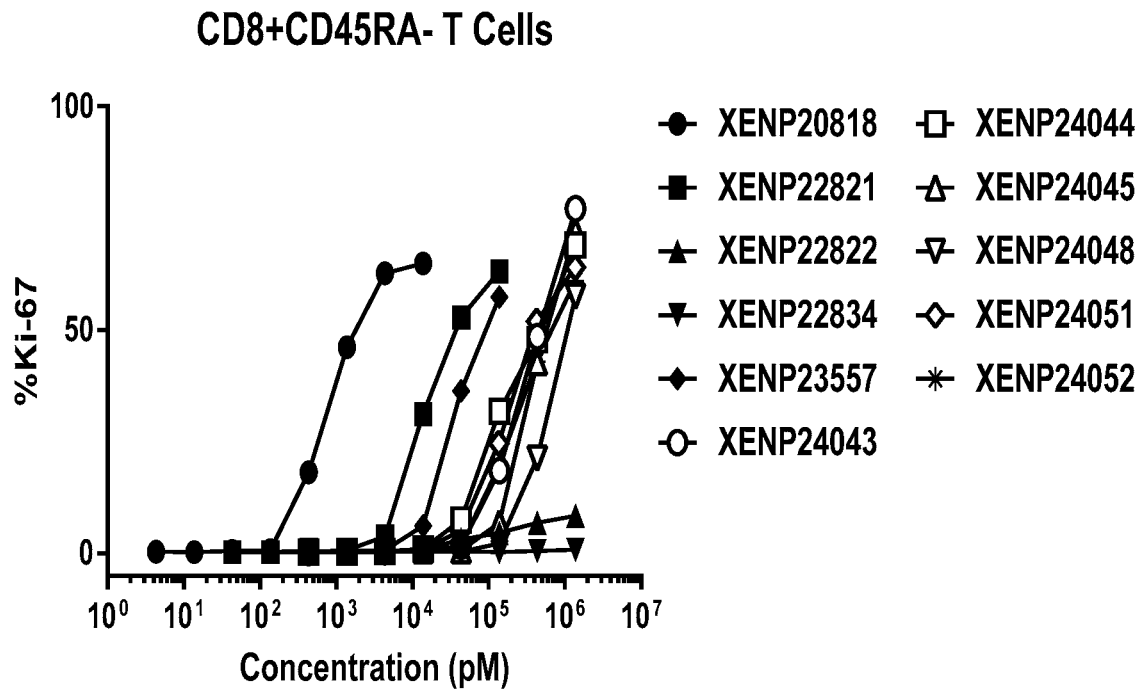
Figure 57B:
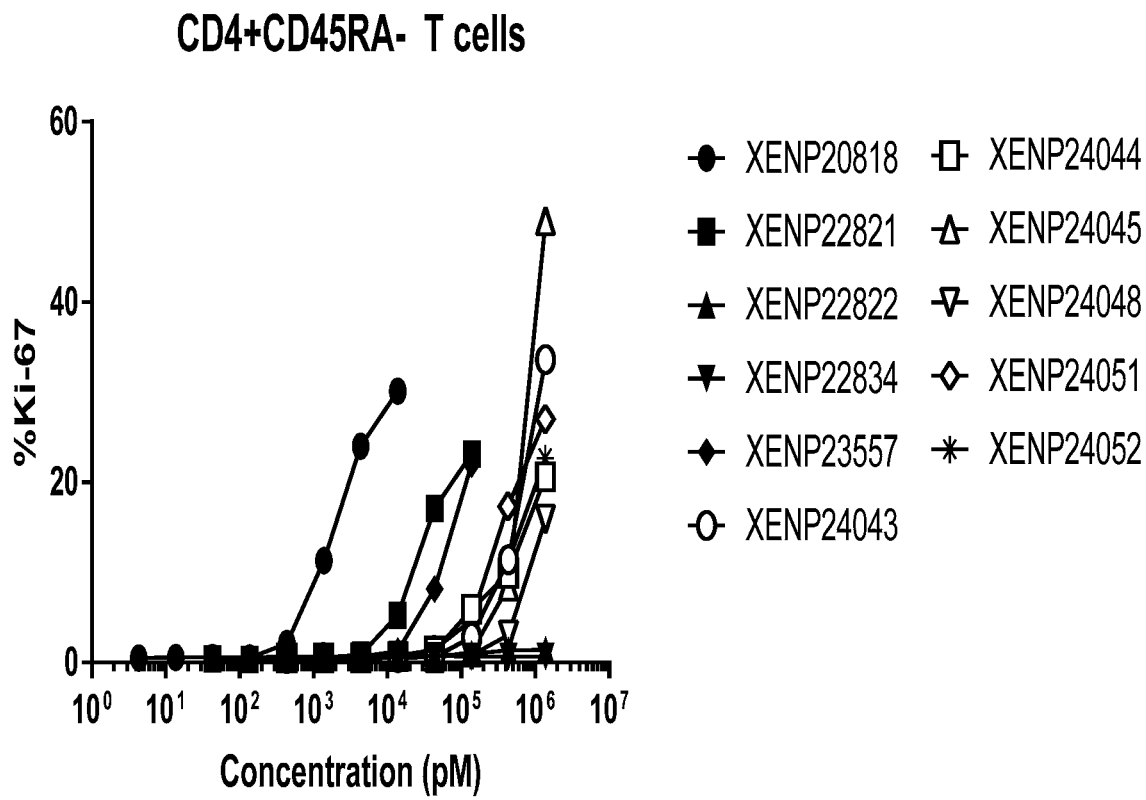
Figure 57C:
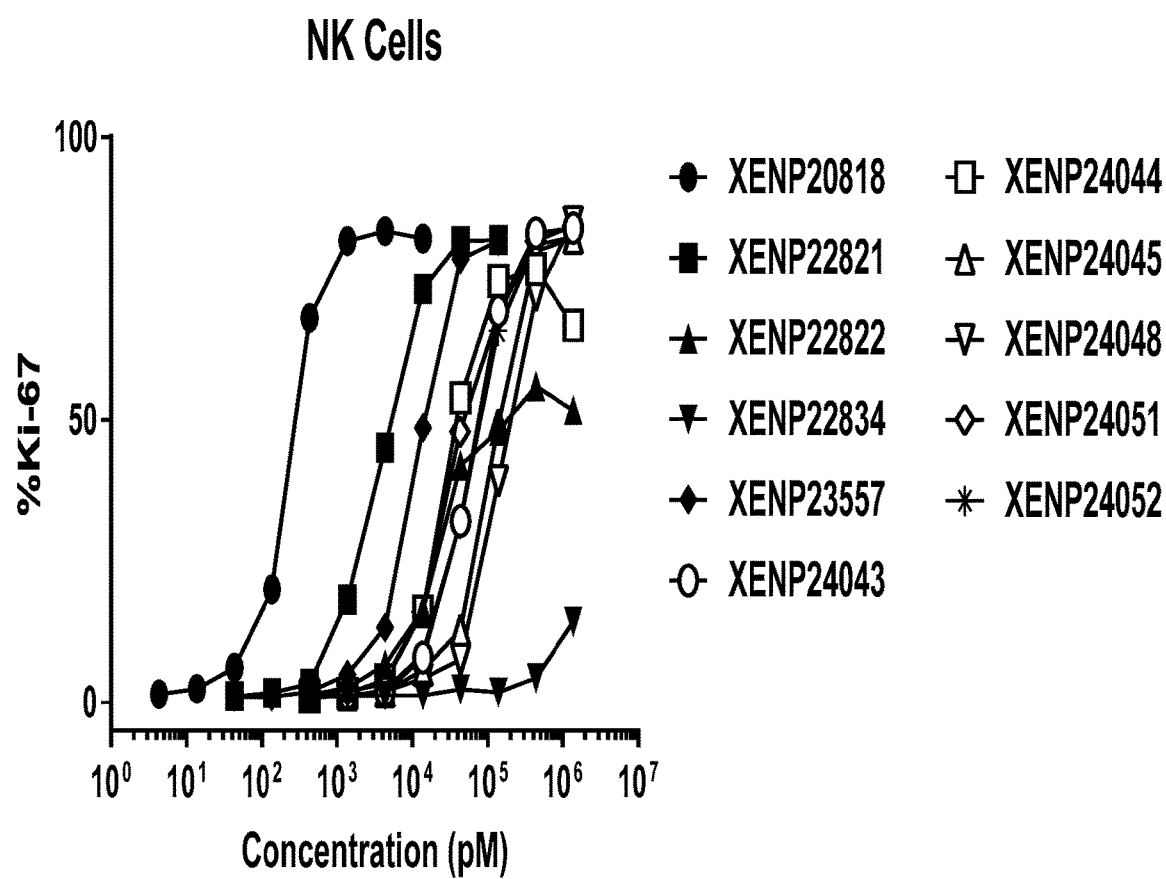
Figure 58A:
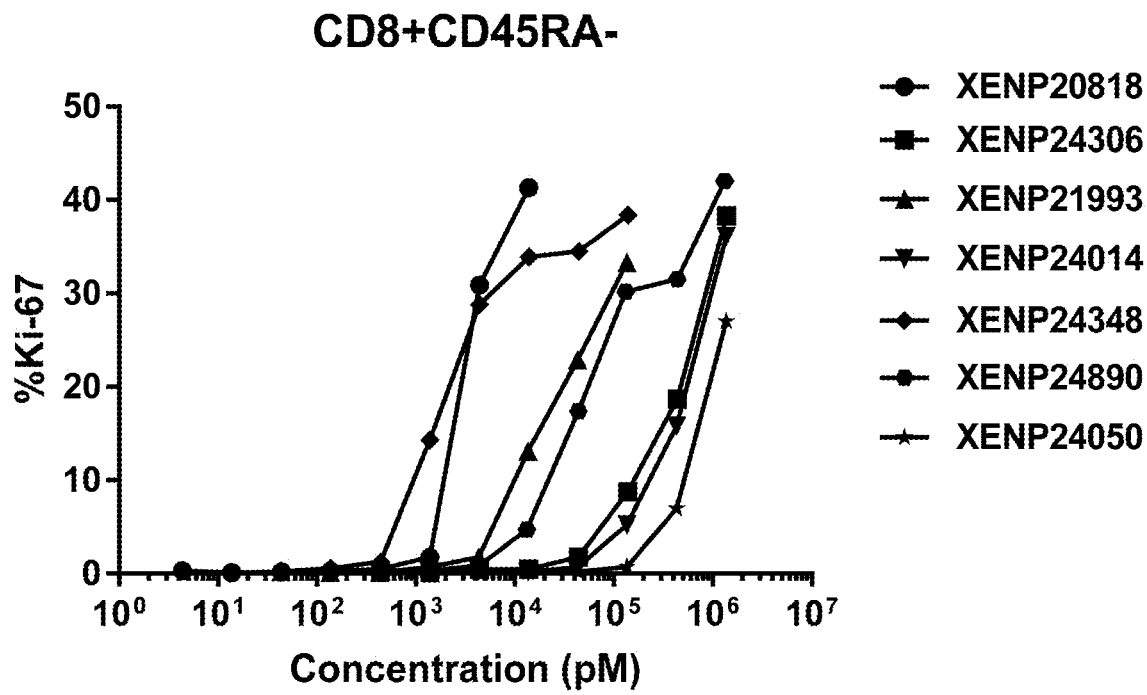
Figure 58B:
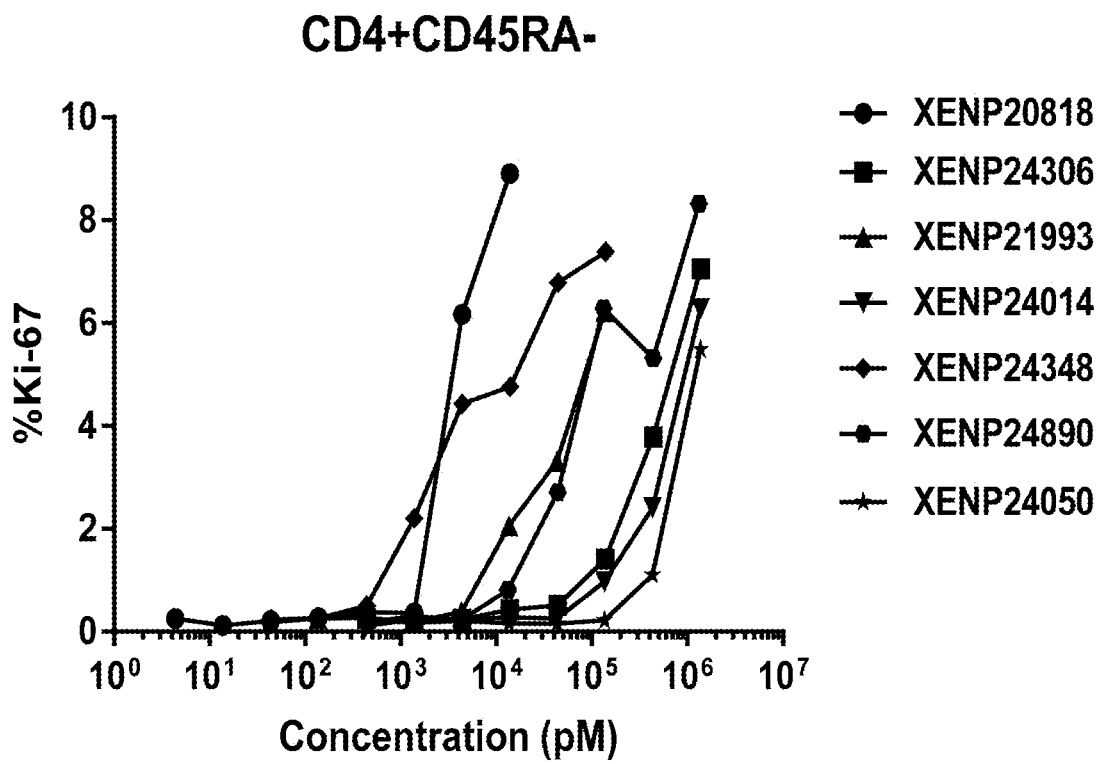
Figure 58C:
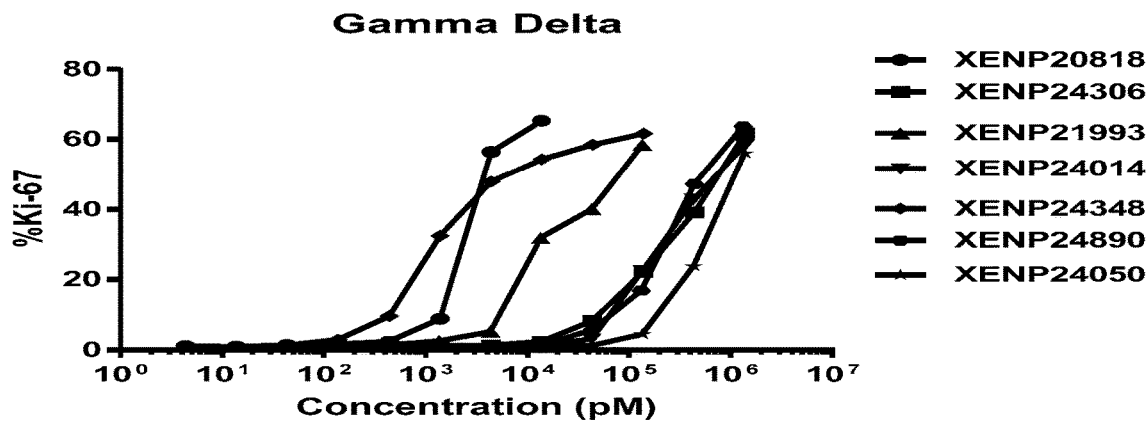
Figure 58D:
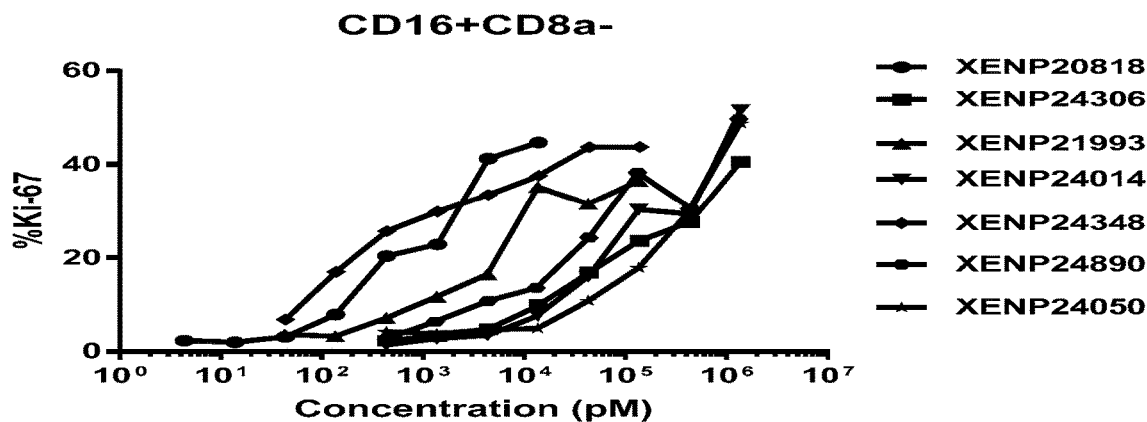
Figure 58E:
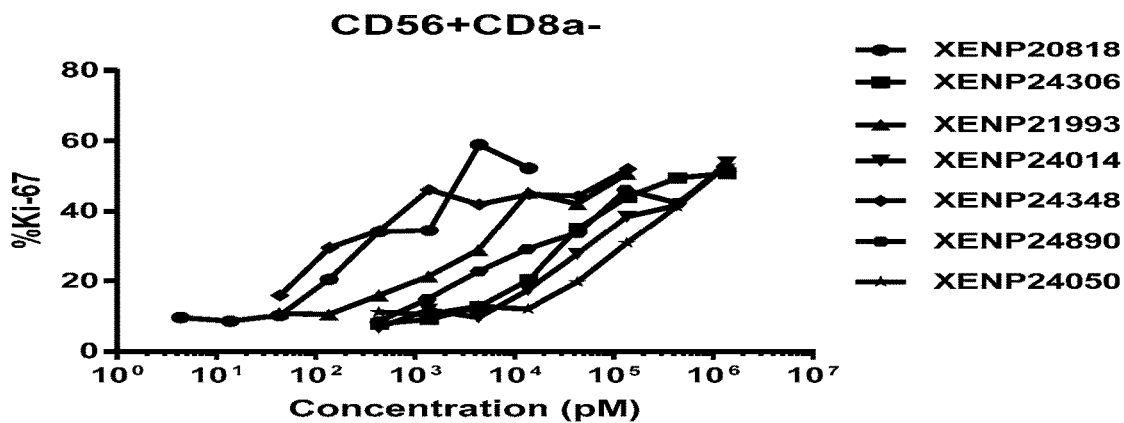
Figure 59A:
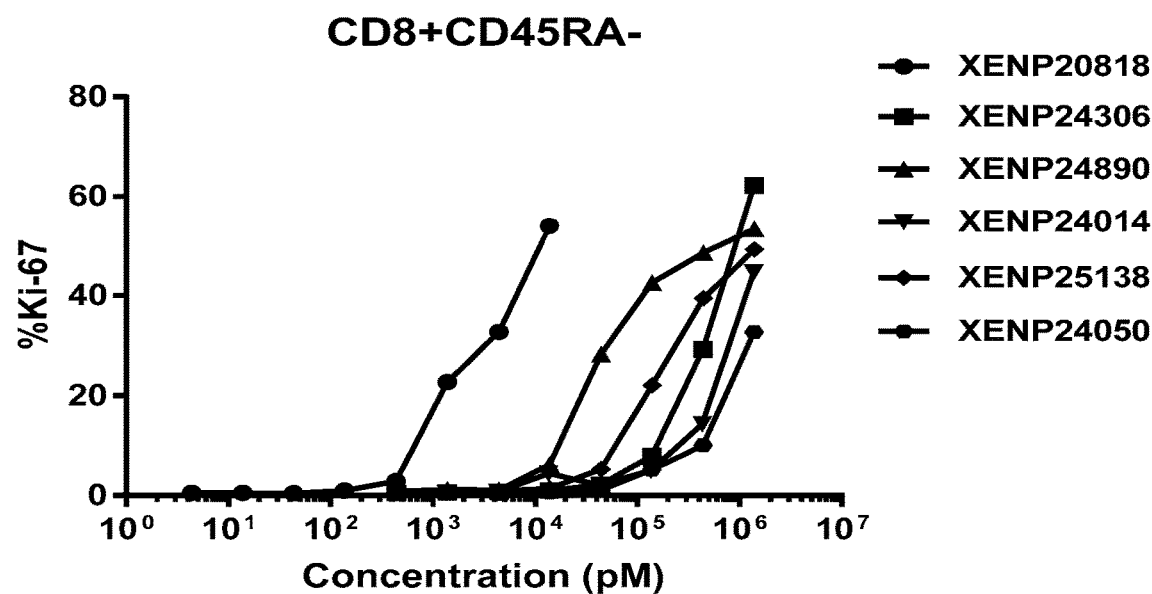
Figure 59B:
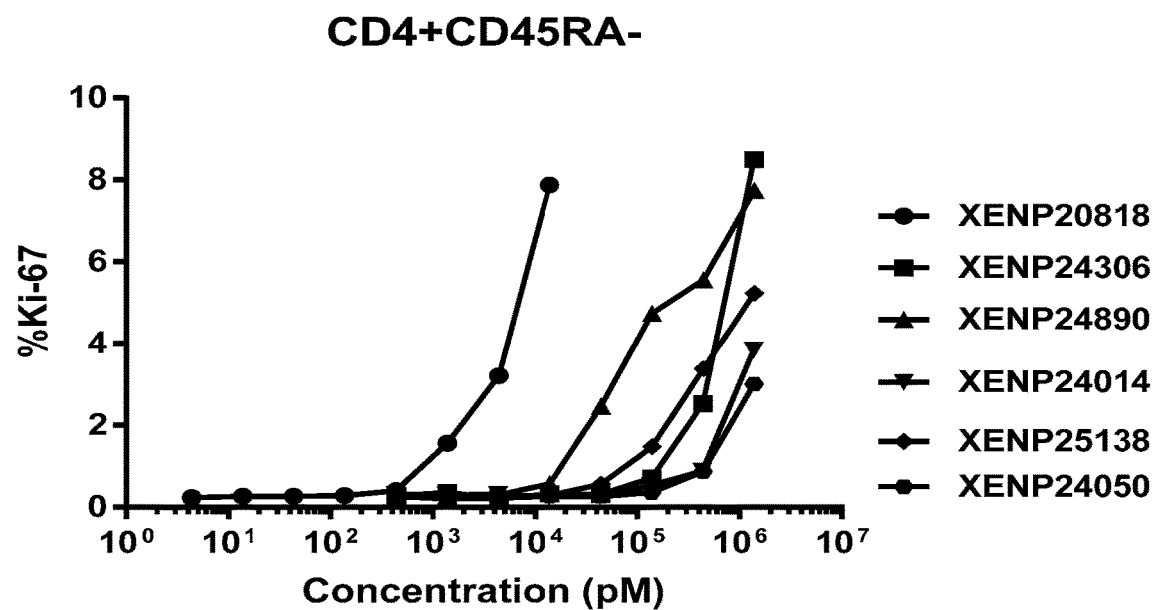
Figure 59C:
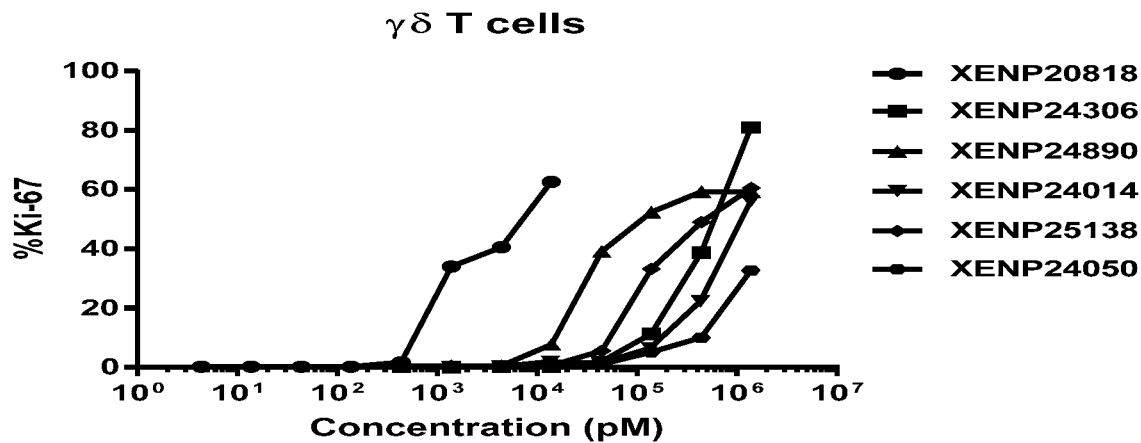
Figure 59D:
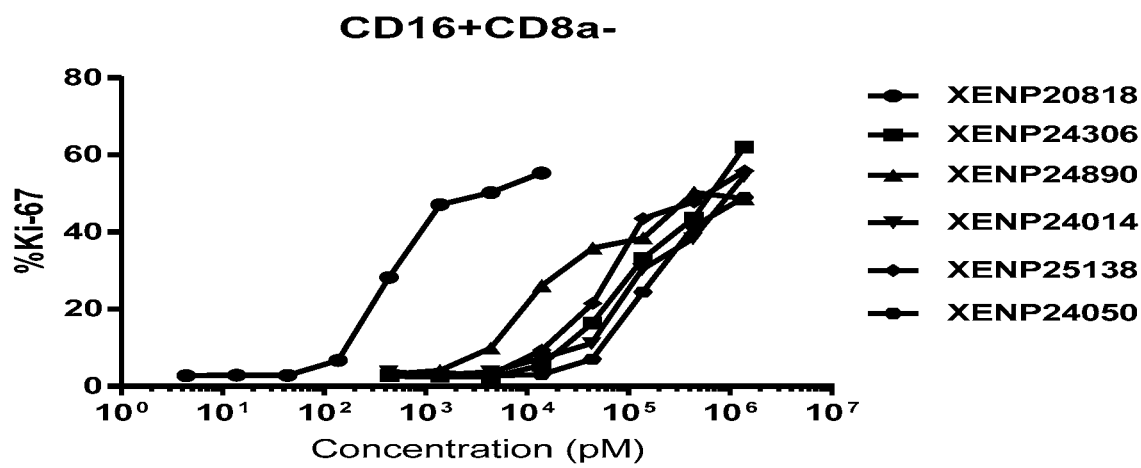
Figure 59E:
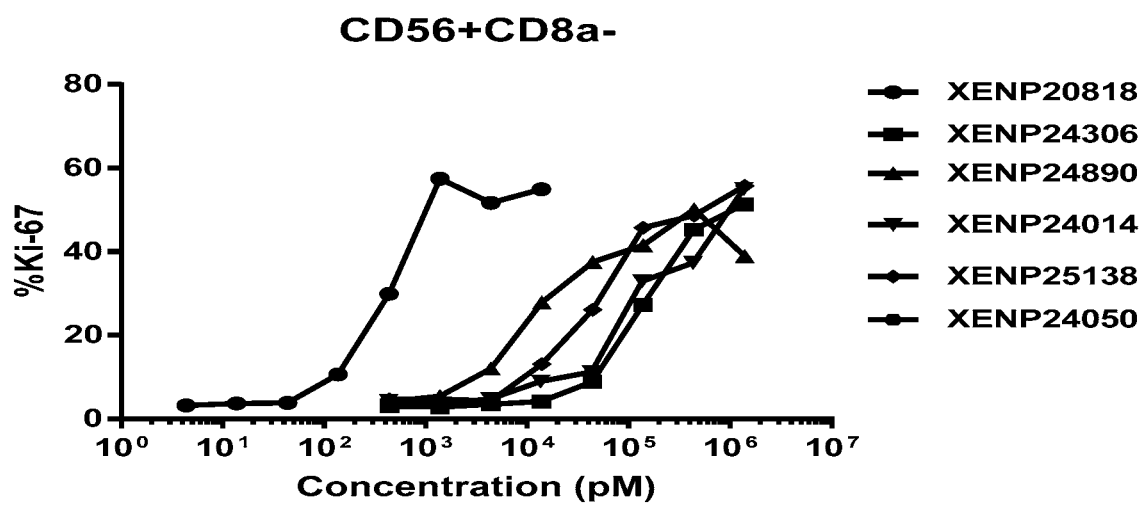
Figure 60A:
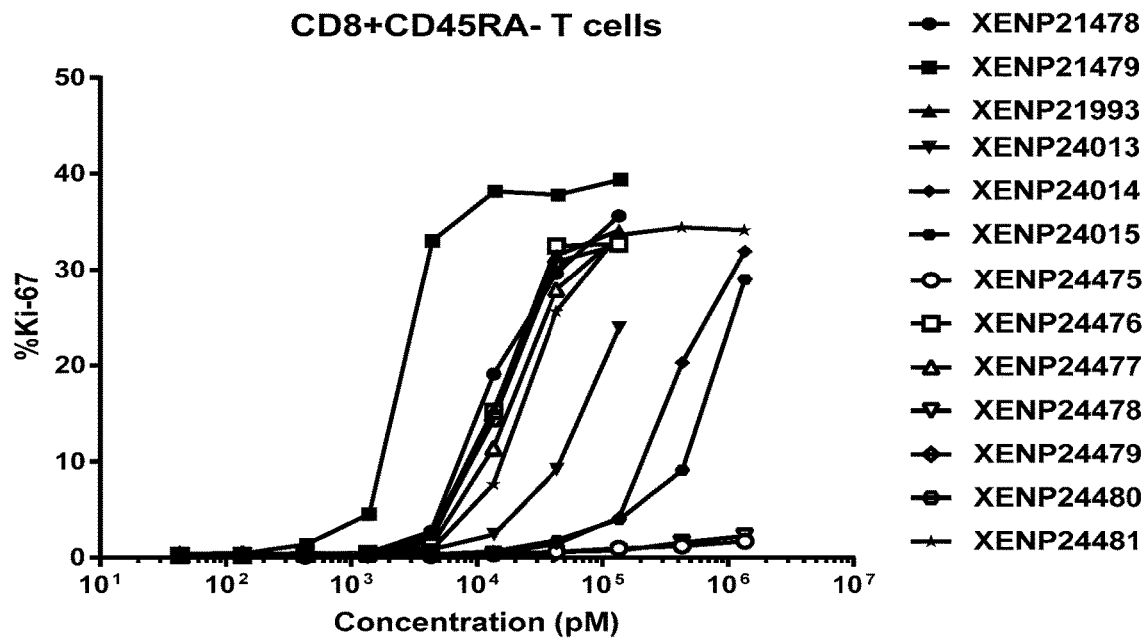
Figure 60B:
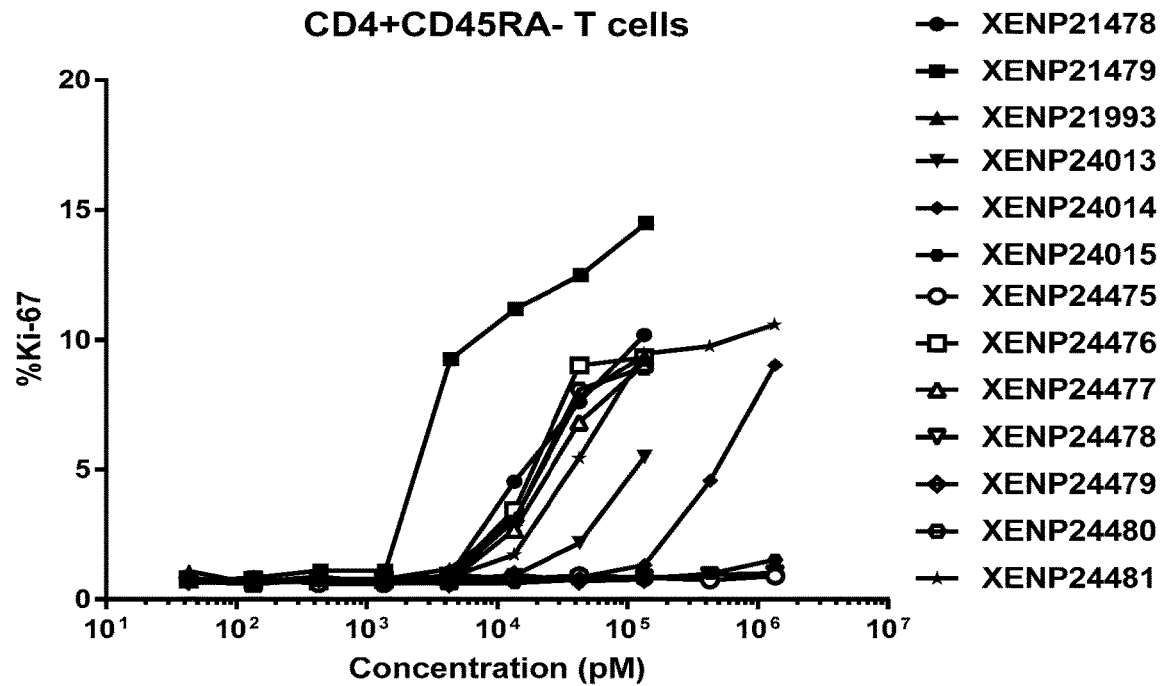
Figure 60C:
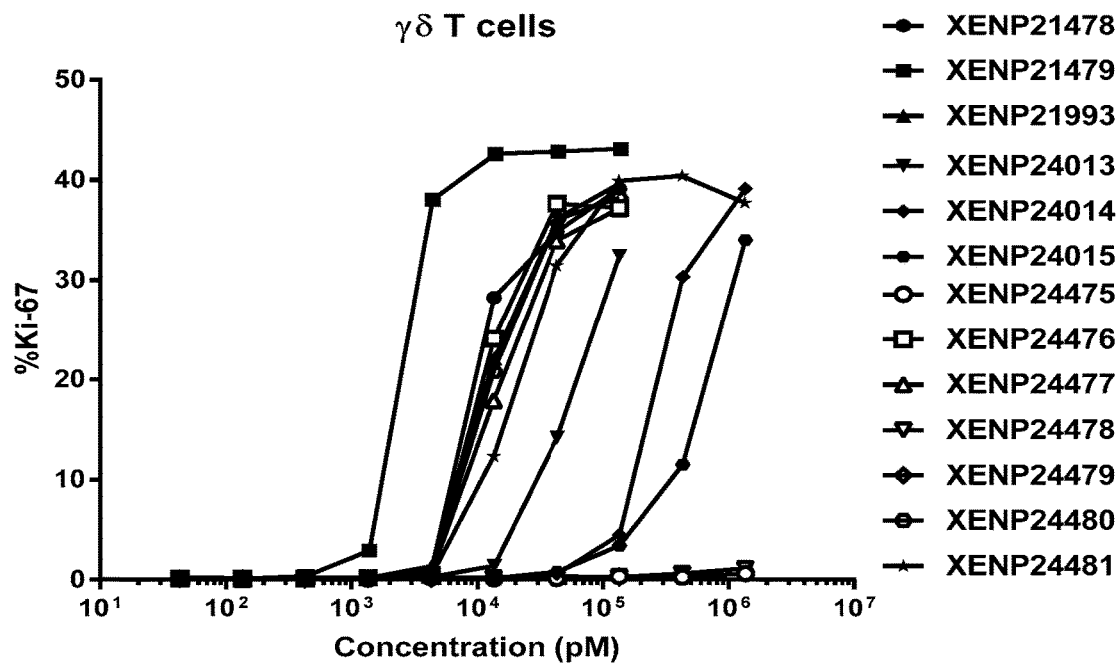
Figure 60D:
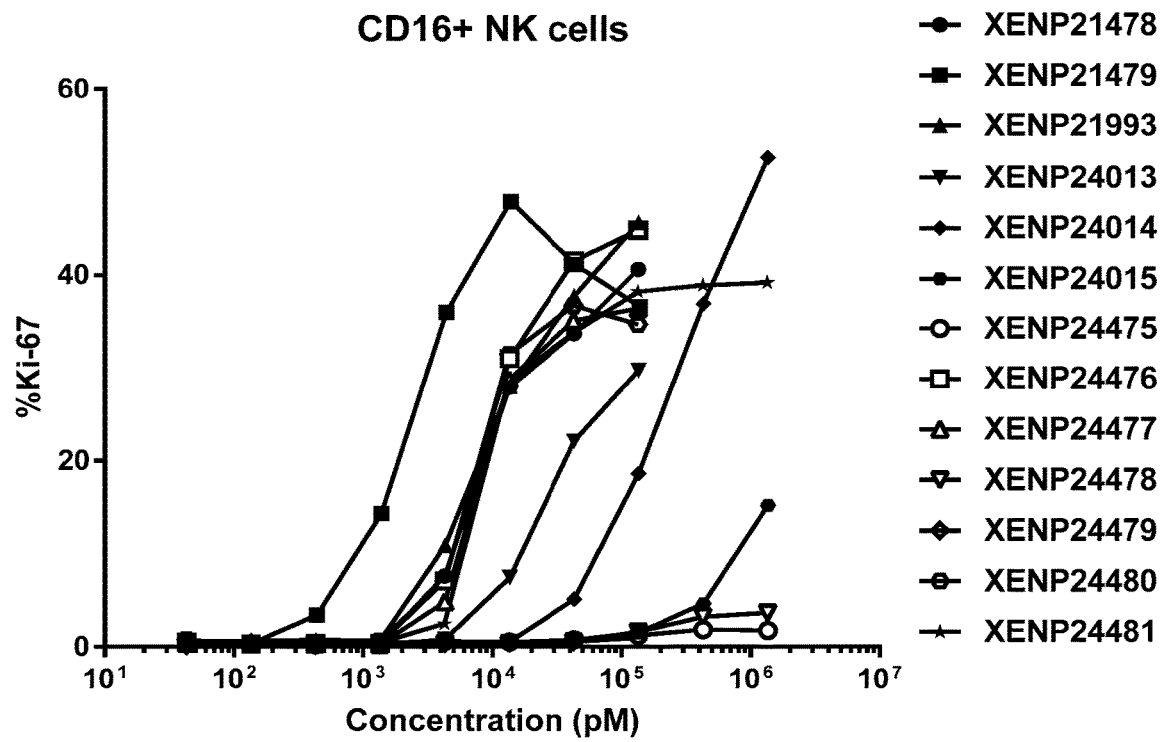
Figure 61A:
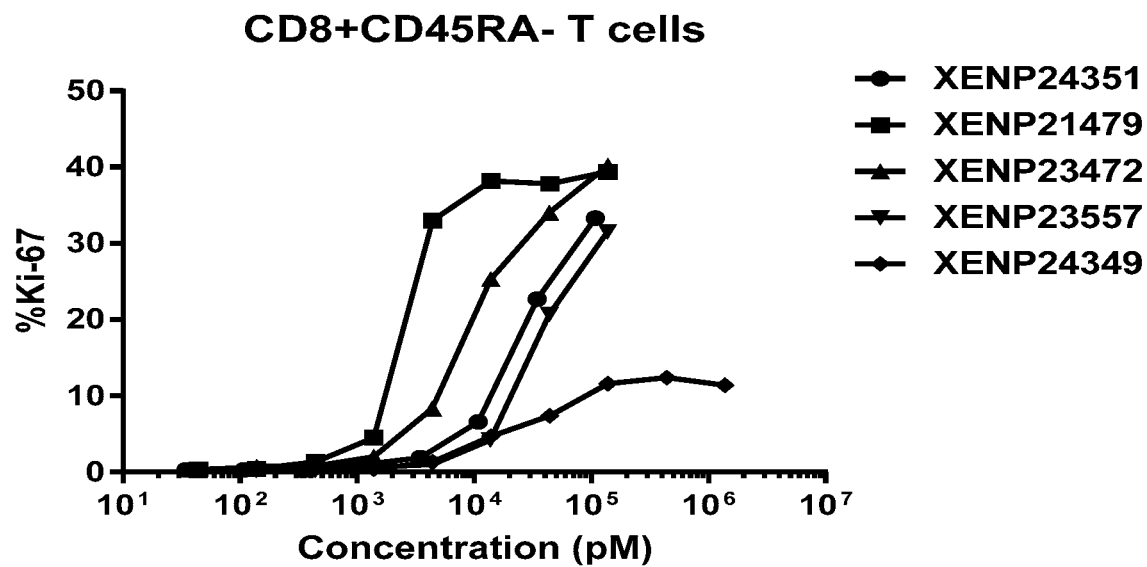
Figure 61B:
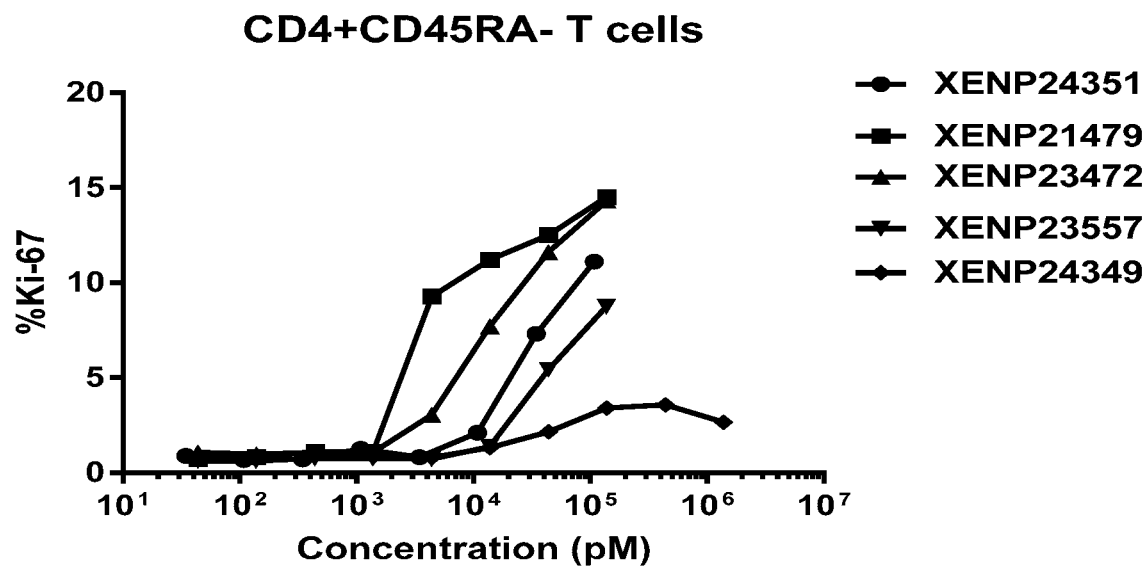
Figure 61C:
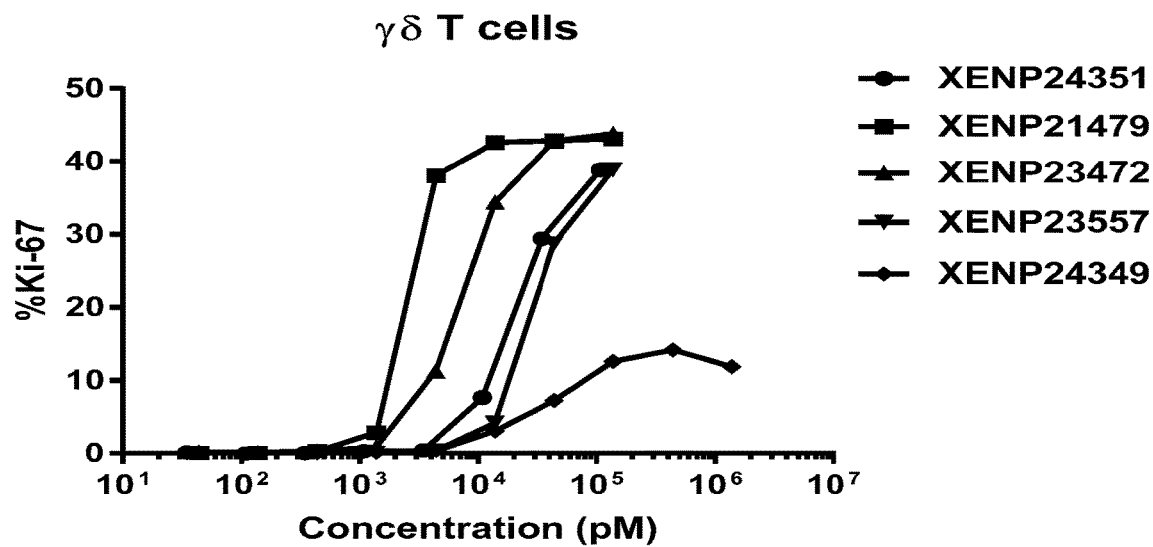
Figure 61D:
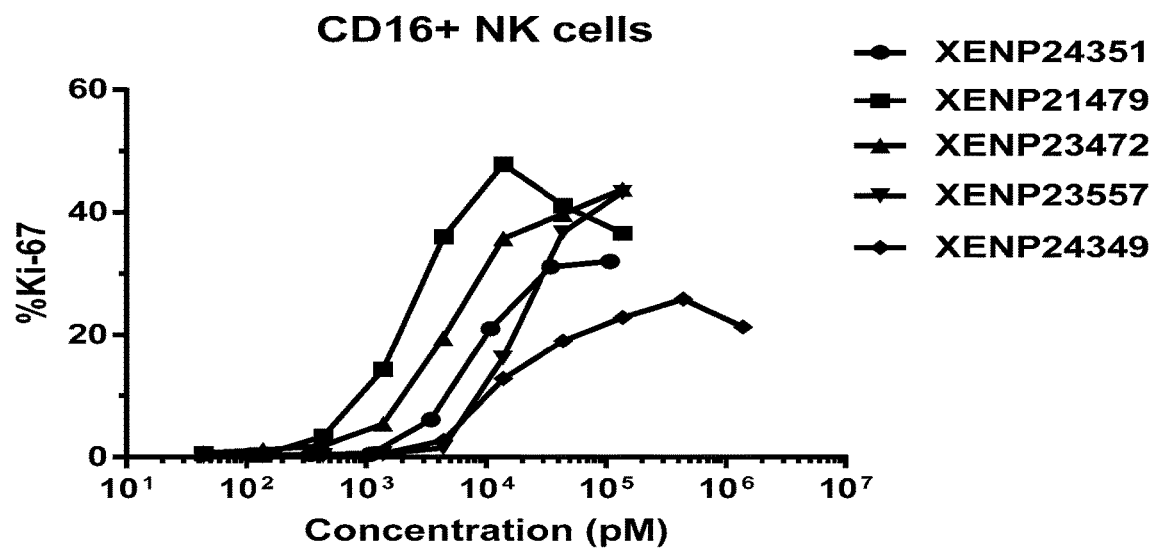

FIG. 57A-57C depicts the percentage of Ki67 expression on (A) CD8+ T cells, (B) CD4+ T cells, and (C) NK cells following treatment with additional IL-15/Rα variants.

FIG. 58A-58E depicts the percentage of Ki67 expression on (A) CD8+ (CD45RA−) T cells, (B) CD4+ (CD45RA−) T cells, (C) γδ T cells, (D) NK (CD16+CD8α−) cells, and (E) NK (CD56+CD8α−) cells following treatment with IL-15/Rα variants.

FIG. 59A-59E depicts the percentage of Ki67 expression on (A) CD8+ (CD45RA−) T cells, (B) CD4+ (CD45RA−) T cells, (C) γδ T cells, (D) NK (CD16+CD8α−) cells, and (E) NK (CD56+CD8α−) cells following treatment with IL-15/Rα variants.

FIG. 60A-60D depicts the percentage of Ki67 expression on (A) CD8+ T cells, (B) CD4+ T cells, (C) γδ T cells and (D) NK (CD16+) cells following treatment with additional IL-15/Rα variants.

FIG. 61A-61D depicts the percentage of Ki67 expression on (A) CD8+ T cells, (B) CD4+ T cells, (C) γδ T cells and (D) NK (CD16+) cells following treatment with additional IL-15/Rα variants.

Figure 62:
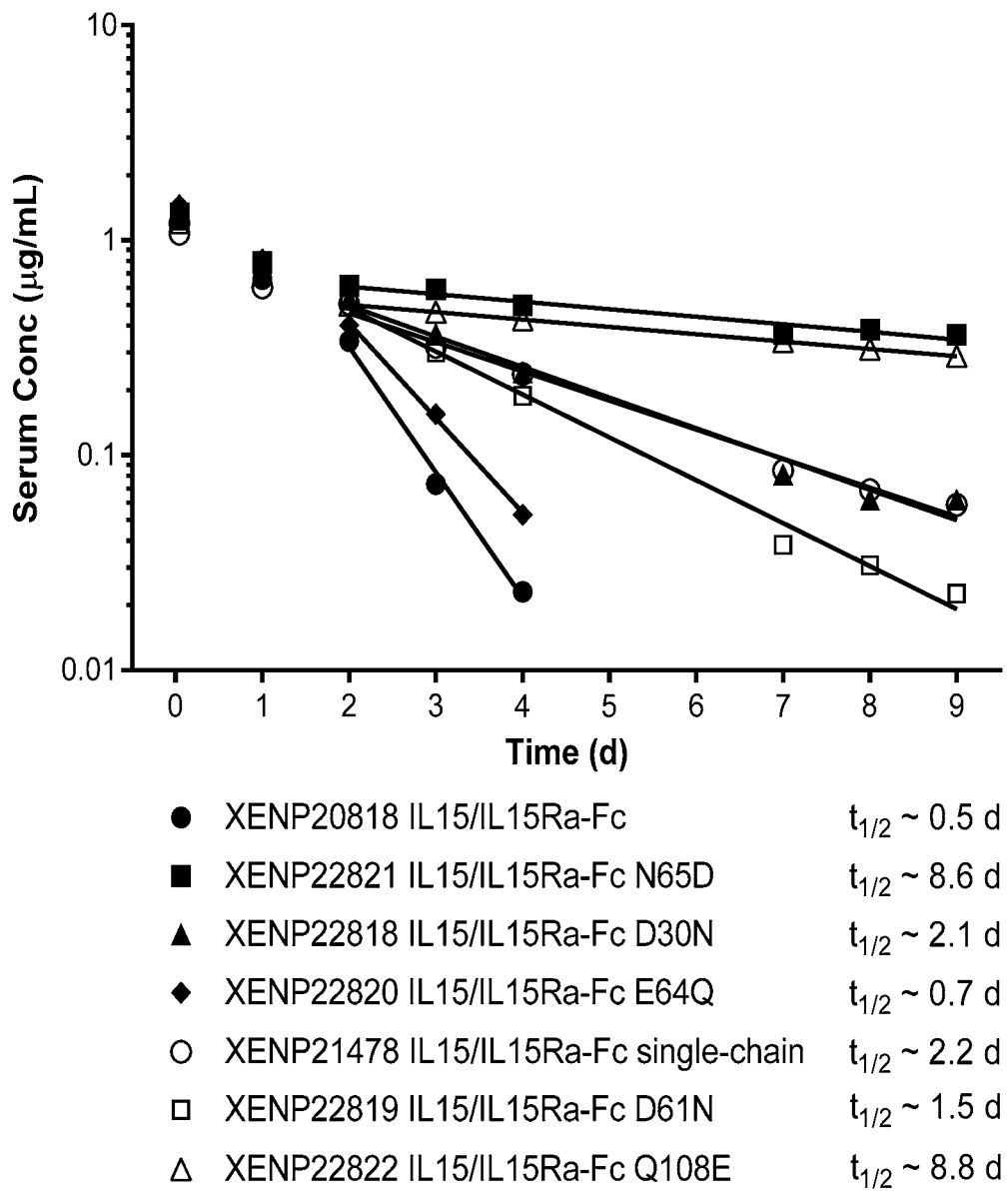
Figure 63:
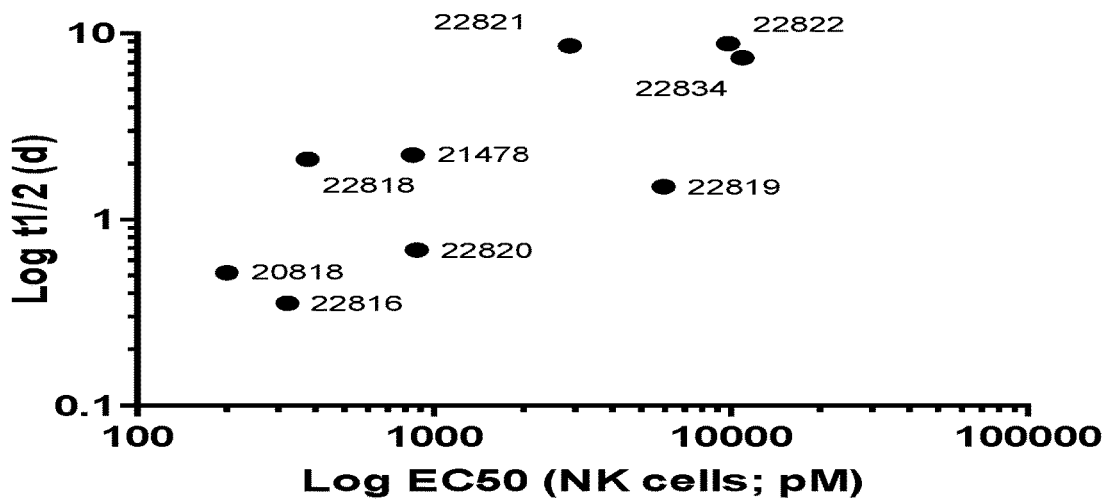

FIG. 62 depicts IV-TV Dose PK of various IL-15/Rα Fc fusion proteins or controls in C57BL/6 mice at 0.1 mg/kg single dose FIG. 63 depicts the correlation of half-life vs NK cell potency following treatment with IL-15/Rα-Fc fusion proteins engineered for lower potency.

FIG. 64A-64K depicts several formats for the IL-15/Rα× anti-PD-1 bifunctional proteins of the present invention. The "scIL-15/RαxscFv" format (FIG. 64A) comprises IL-15Rα (sushi) fused to IL-15 by a variable length linker (termed "scIL-15/Rα") which is then fused to the N-terminus of a heterodimeric Fc-region, with an scFv fused to the other side of the heterodimeric Fc. The "scFvxncIL-15/Rα" format (FIG. 64B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed. The "scFvxdsIL-15/Rα" format (FIG. 64C) is the same as the "scFvxncIL-15/Rα" format, but wherein IL-15Rα(sushi) and IL-15 are covalently linked as a result of engineered cysteines. The "scIL-15/RαxFab" format (FIG. 64D) comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. The "ncIL-15/RαxFab" format (FIG. 64E) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. The "dsIL-15/RαxFab" format (FIG. 64F) is the same as the "ncIL-15/RαxFab" format, but wherein IL-15Rα(sushi) and IL-15 are covalently linked as a result of engineered cysteines. The "mAb-scIL-15/Rα" format (FIG. 64G) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs. The "mAb-ncIL-15/Rα" format (FIG. 64H) comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed. The "mAb-dsIL-15/Rα" format (FIG. 64I) is the same as the "mAb-ncIL-15/Rα" format, but wherein IL-15Rα(sushi) and IL-15 are covalently linked as a result of engineered cysteines. The "central-IL-15/Rα" format (FIG. 64J) comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs. The "central-scIL-15/Rα" format (FIG. 64K) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs.

FIG. 65 depicts sequences of XENP21480, an illustrative IL-15/Rαxanti-PD-1 bifunctional protein of the "scIL-15/RαxscFv" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 66 depicts sequences of an illustrative IL-15/Rαx anti-PD-1 bifunctional protein of the "scFvxncIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 67 depicts sequences of an illustrative IL-15/Rαx anti-PD-1 bifunctional protein of the "scFvxdsIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 68A-68C depicts sequences of illustrative IL-15/ Rαxanti-PD-1 bifunctional proteins of the "scIL-15/Rα× Fab" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted FIGS. 8 and 9A-9C), and slashes (/) indicate the border(s) between IL-15, IL-15Rα, linkers, variable regions, and constant/Fc regions.

FIG. 69 depicts sequences of XENP22112, an illustrative IL-15/Rαxanti-PD-1 bifunctional protein of the "FabxncIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 70 depicts sequences of XENP22641, an illustrative IL-15/Rα×anti-PD-1 bifunctional protein of the "Fab×dsIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 71A-71B depicts sequences of an illustrative IL-15/Rα×anti-PD-1 bifunctional protein of the "mAb×scIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 72 depicts sequences of XENP22642 and XENP22643, illustrative IL-15/Rα×anti-PD-1 bifunctional proteins of the "mAb×ncIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 73 depicts sequences of XENP22644 and XENP22645, illustrative IL-15/Rα×anti-PD-1 bifunctional proteins of the "mAb×dsIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the VII and VL domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 74 depicts sequences of illustrative IL-15/Rα×anti-PD-1 bifunctional proteins of the "central-IL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 75 depicts sequences of illustrative IL-15/Rα×anti-PD-1 bifunctional proteins of the "central-scIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIGS. 8 and 9A-9C), and slashes (/) indicate the border(s) between IL-15, IL-15Rα, linkers, variable regions, and constant/Fc regions.

FIG. 76A-76F depicts A) the format for illustrative IL-15/Rα×anti-PD-1 bifunctional protein XENP21480, the purity and homogeneity of XENP21480 as determined by B) SEC and C) CEF, the affinity of XENP21480 for D) IL-2Rβ and E) PD-1 as determined by Octet, and F) the stability of XENP21480 as determined by DSF.

Figure 77A:
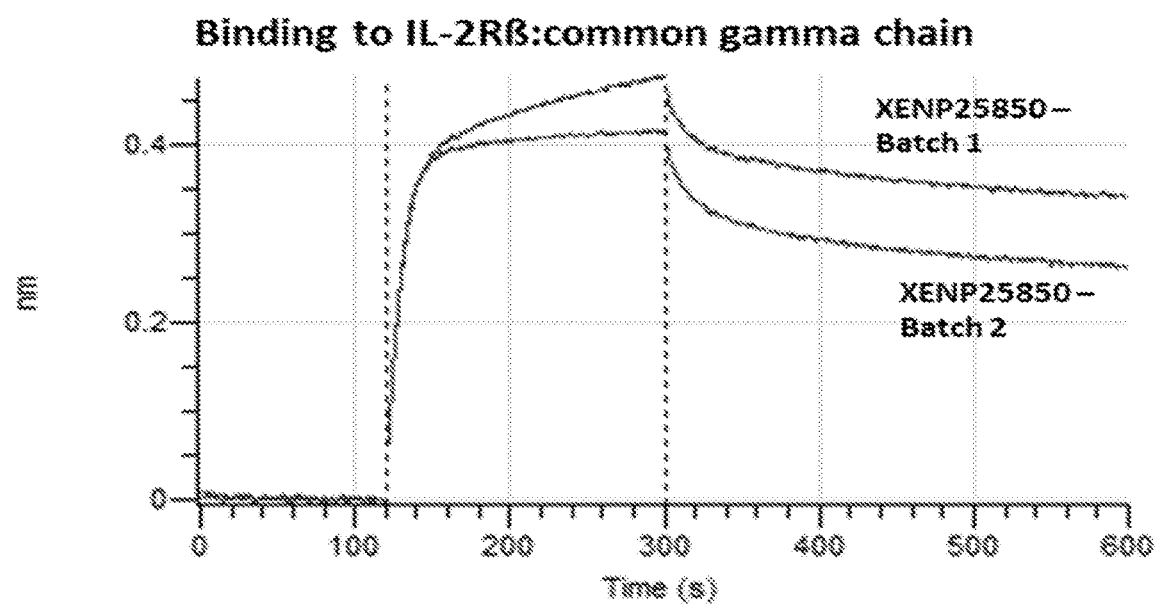
Figure 77B:
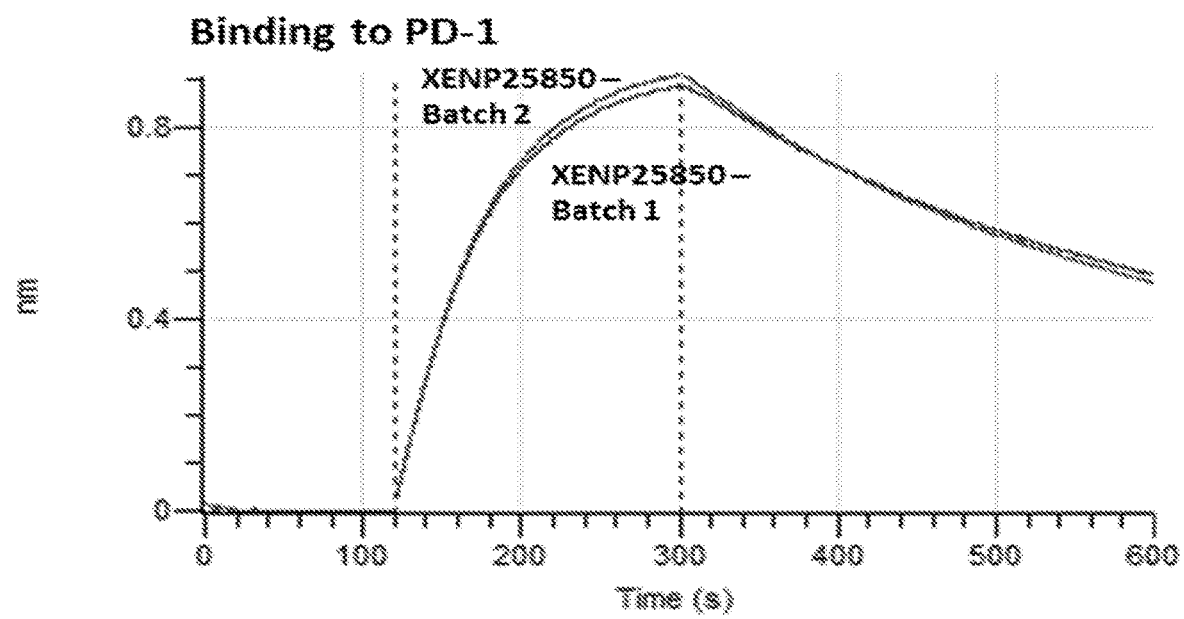

FIG. 77A-77B depicts the sensorgrams from Octet experiment for confirming the binding of two batches of XENP25850 to A) IL-2Rβ:common gamma chain complex and B) PD-1.

Figure 78A:
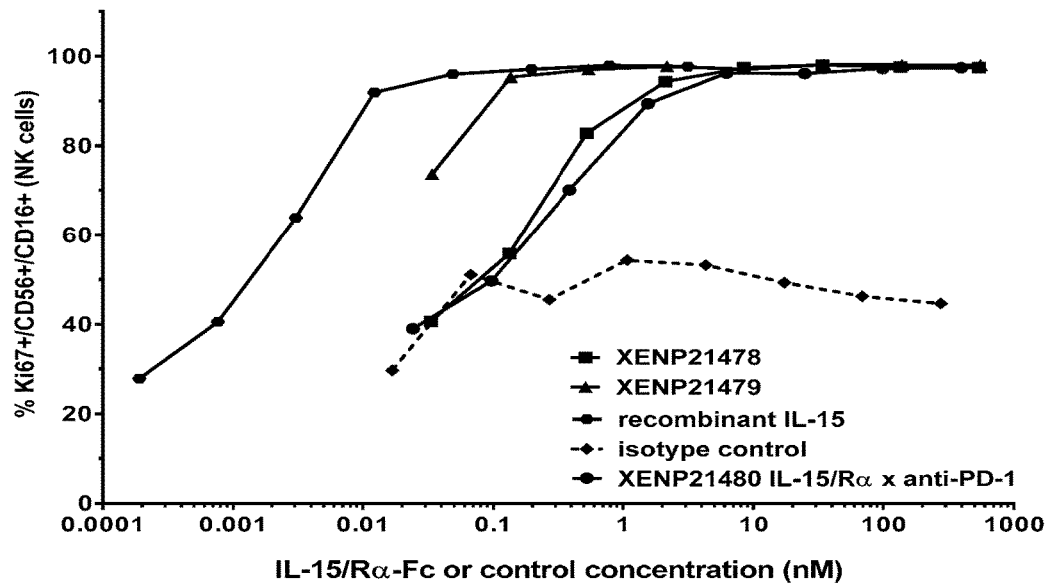
Figure 78B:
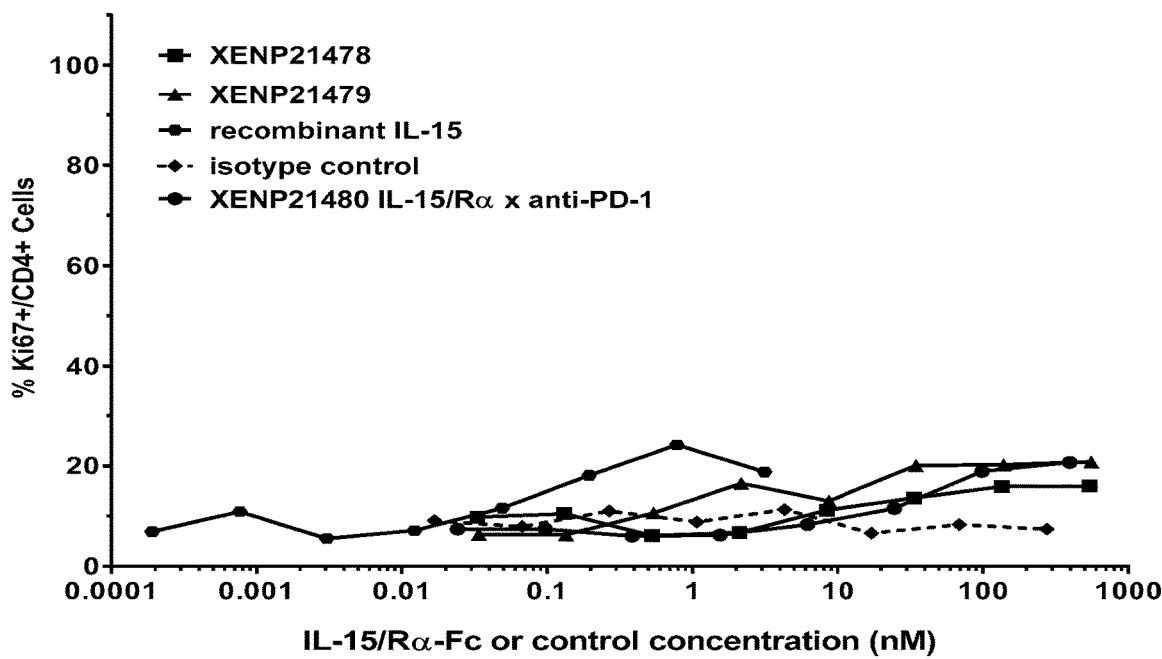
Figure 78C:
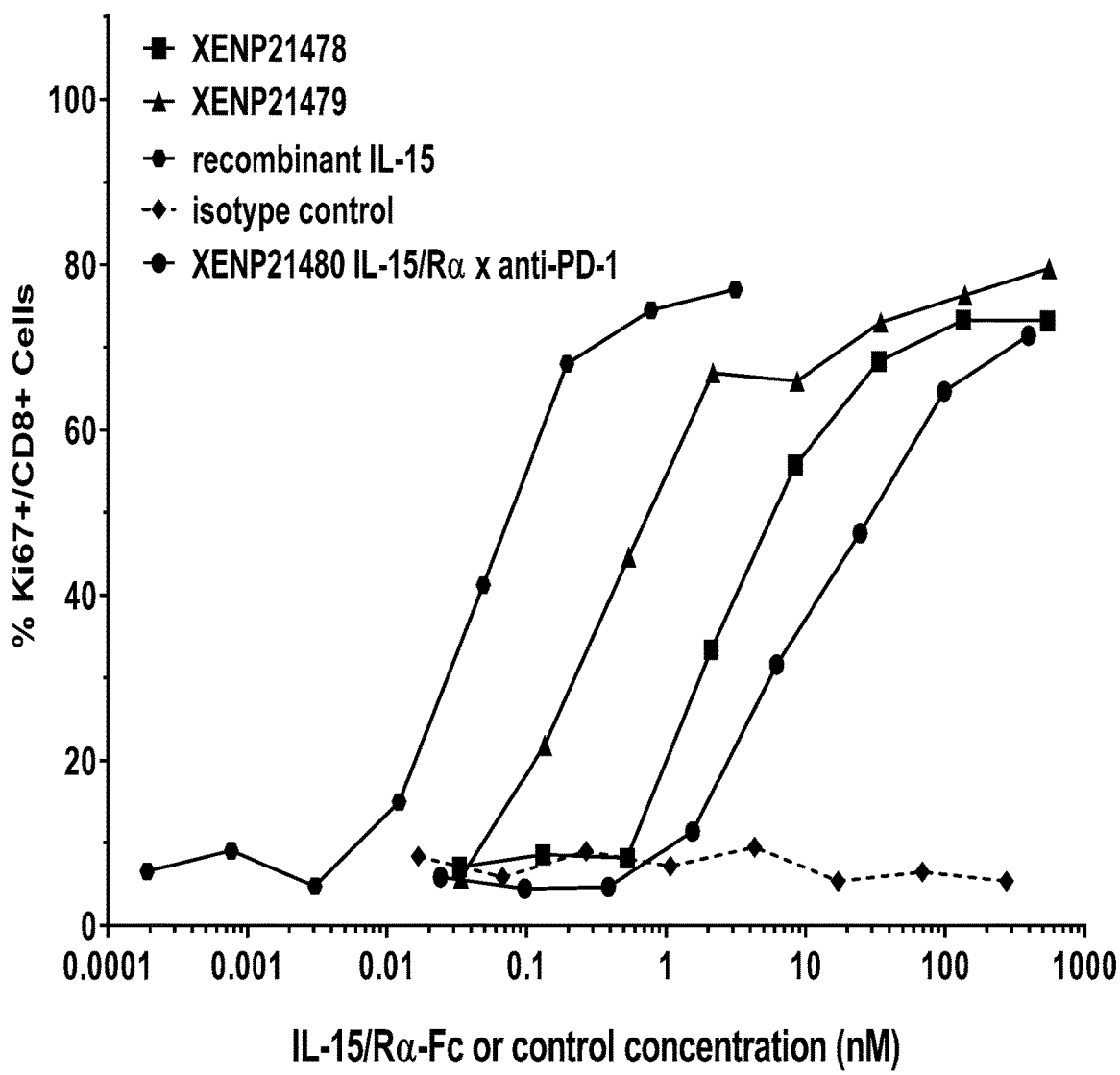

FIG. 78A-78C depicts the induction of A) NK (CD56$^+$/CD16$^+$) cells, B) CD4$^+$ T cells, and C) CD8$^+$ T cells proliferation by illustrative IL-15/Rα×anti-PD-1 bifunctional protein and controls.

Figure 79:
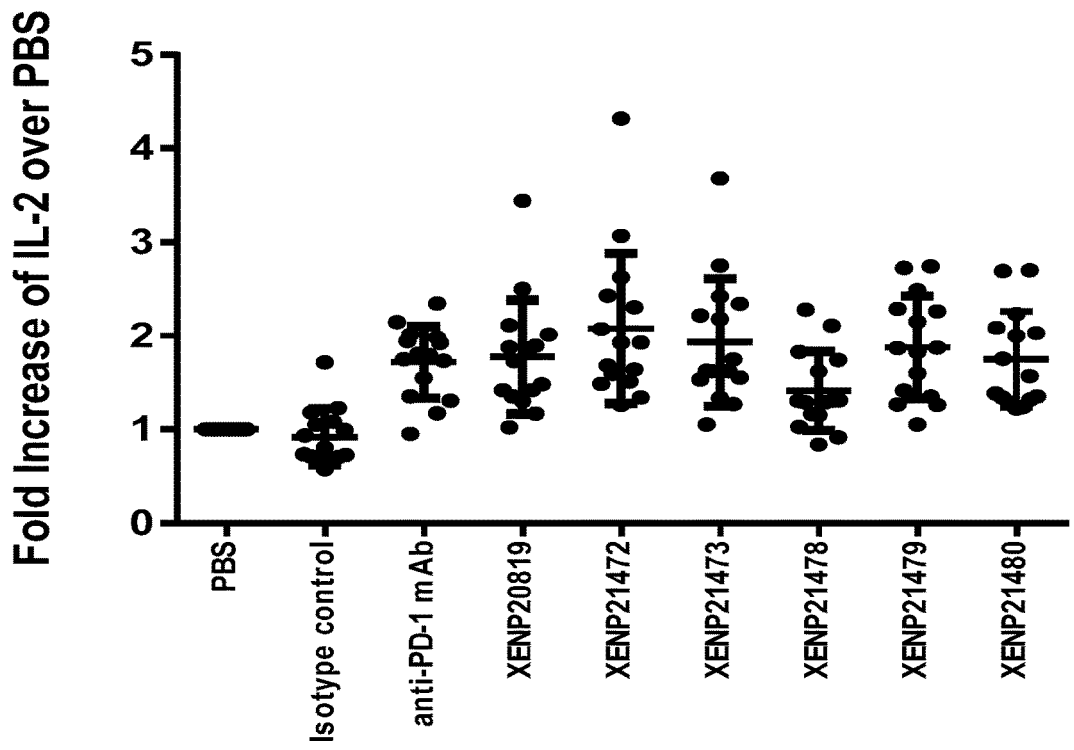

FIG. 79 depicts enhancement of IL-2 secretion by an illustrative IL-15/Rα×anti-PD-1 bifunctional protein and controls over PBS in an SEB-stimulated PBMC assay.

Figure 80:
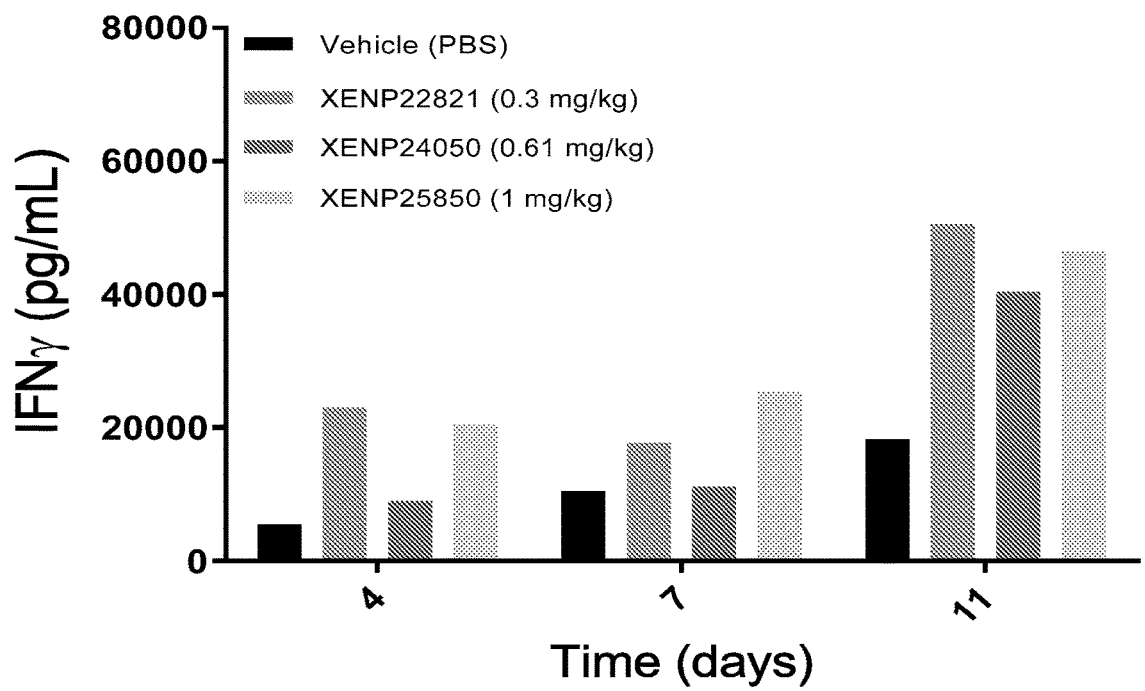

FIG. 80 depicts IFNγ level on Days 4, 7, and 11 in serum of huPBMC engrafted mice following treatment with an illustrative IL-15/Rα×anti-PD-1 bifunctional protein XENP25850 and controls.

Figure 81A:
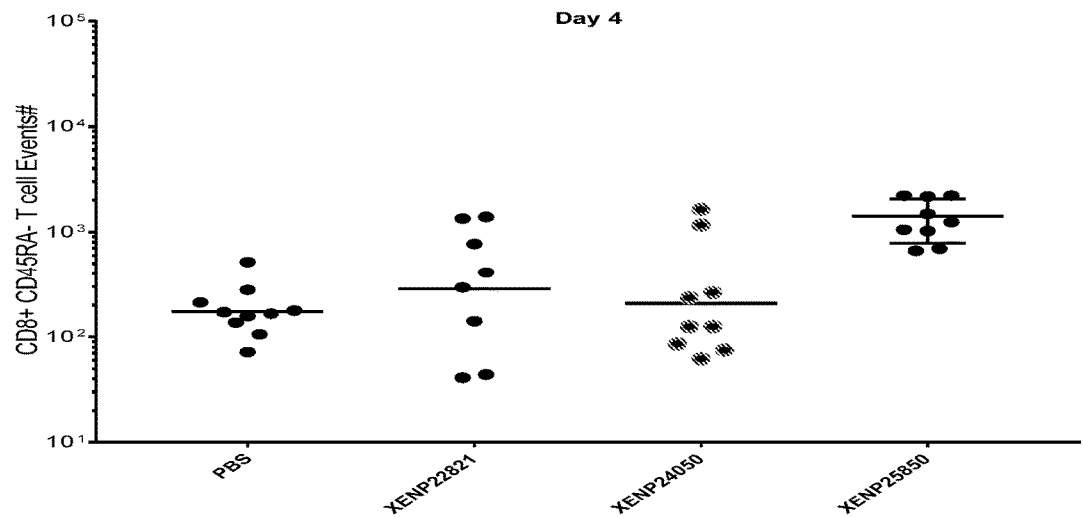
Figure 81B:
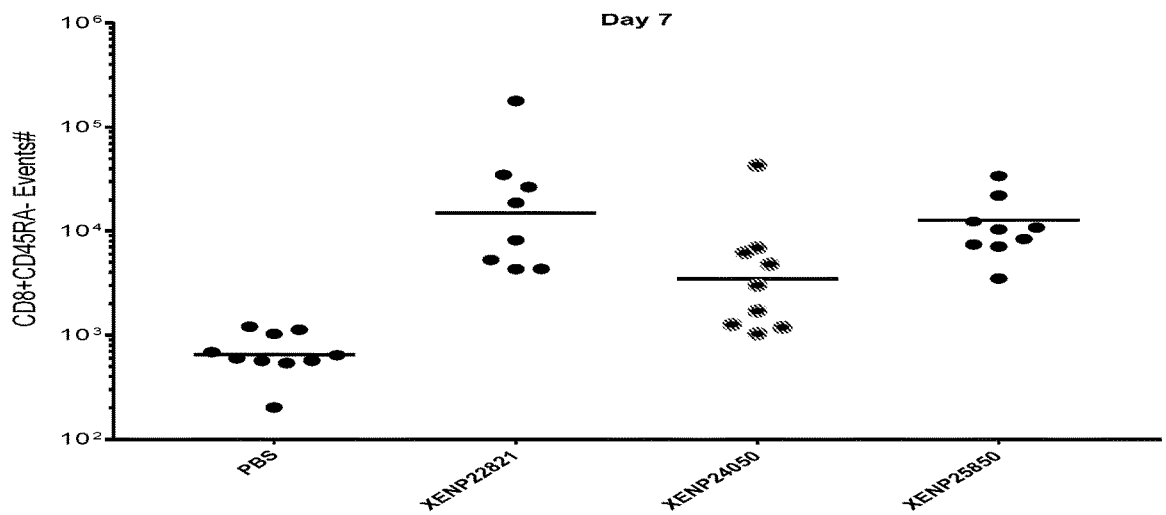
Figure 81C:
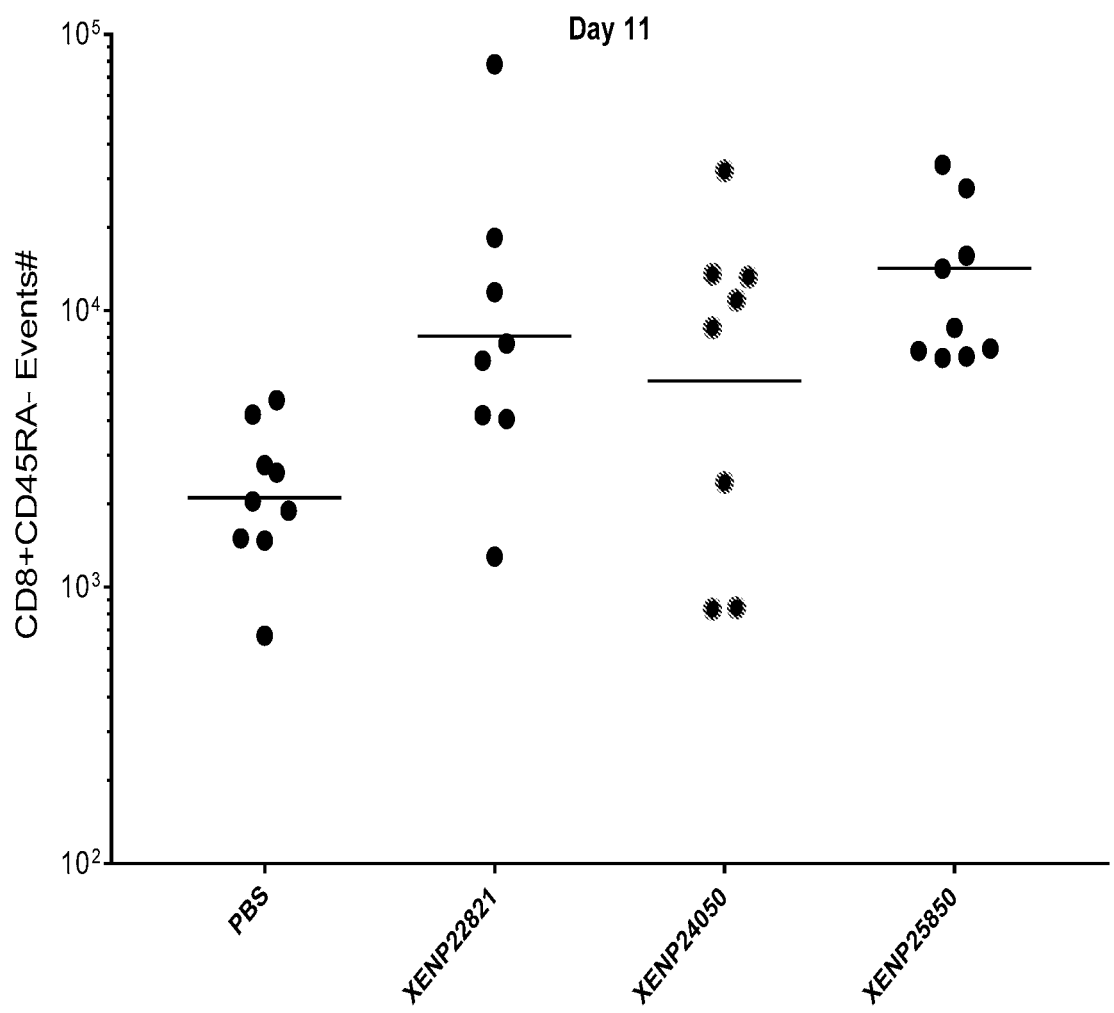

FIG. 81A-81C depicts CD8$^+$ T cell count on Days A) 4, B) 7, and C) 11 in whole blood of huPBMC engrafted mice following treatment with an illustrative IL-15/Rα×anti-PD-1 bifunctional protein XENP25850 and controls.

Figure 82A:
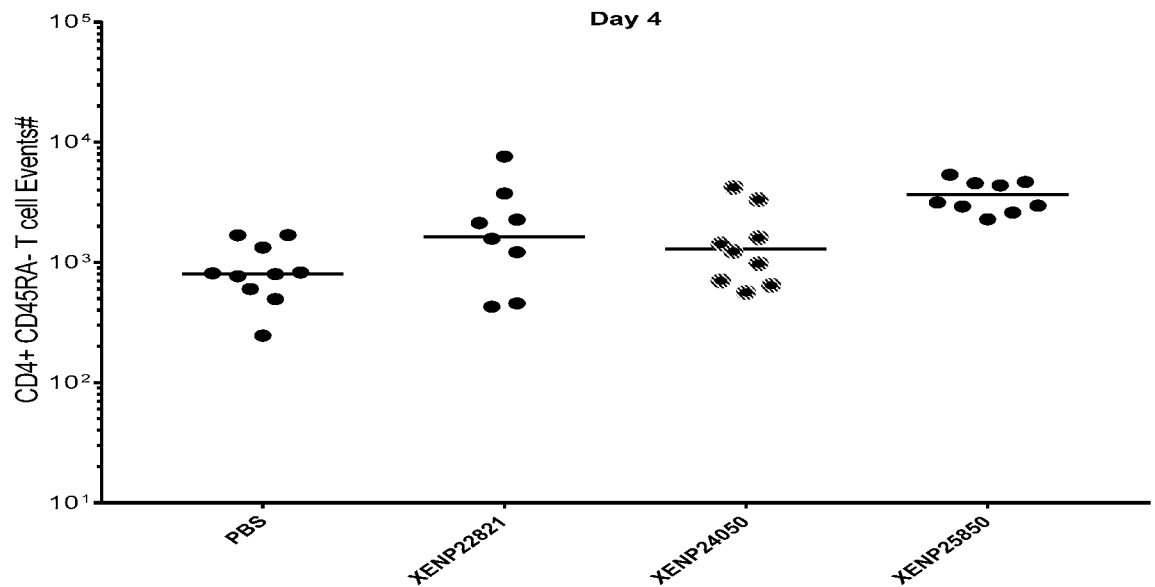
Figure 82B:
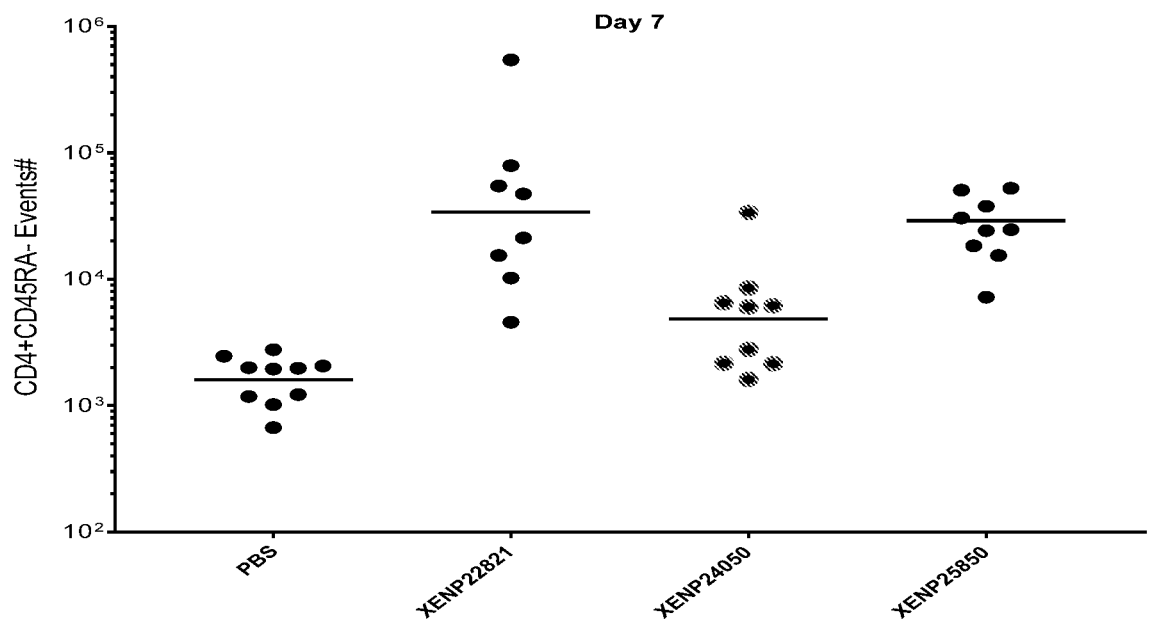
Figure 82C:
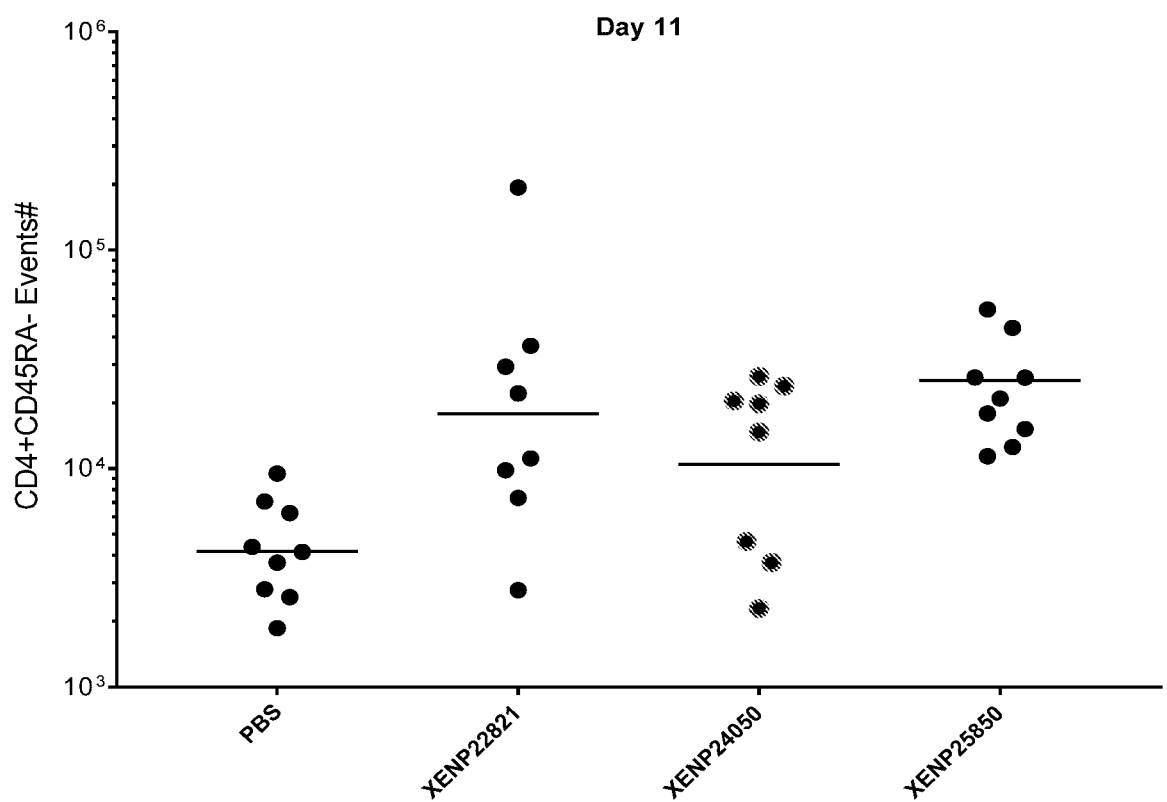

FIG. 82A-82C depicts CD4$^+$ T cell count on Days A) 4, B) 7, and C) 11 in whole blood of huPBMC engrafted mice following treatment with an illustrative IL-15/Rα×anti-PD-1 bifunctional protein XENP25850 and controls.

Figure 83A:
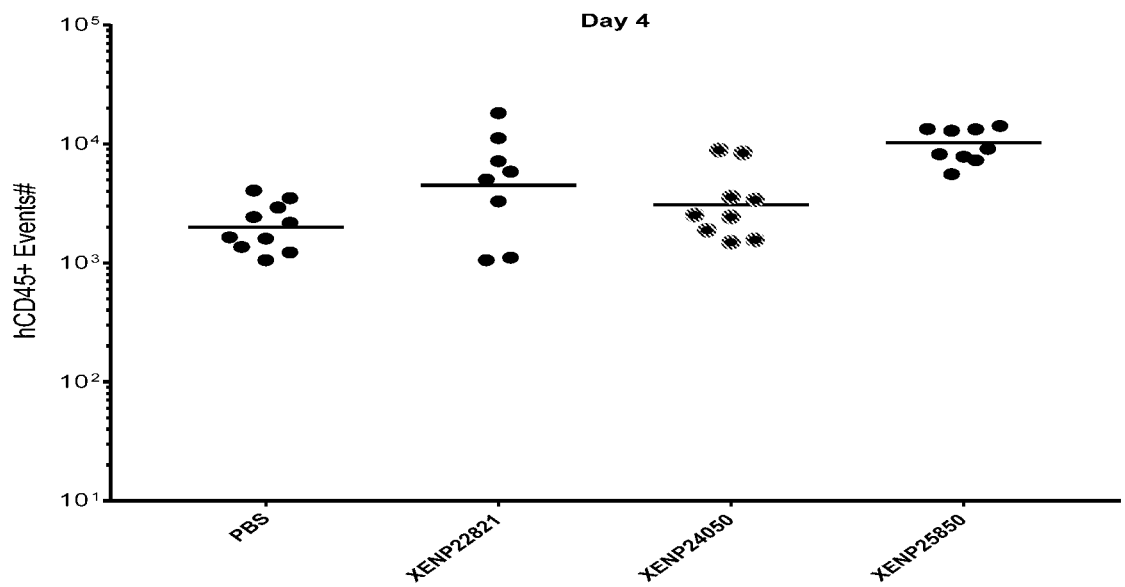
Figure 83B:
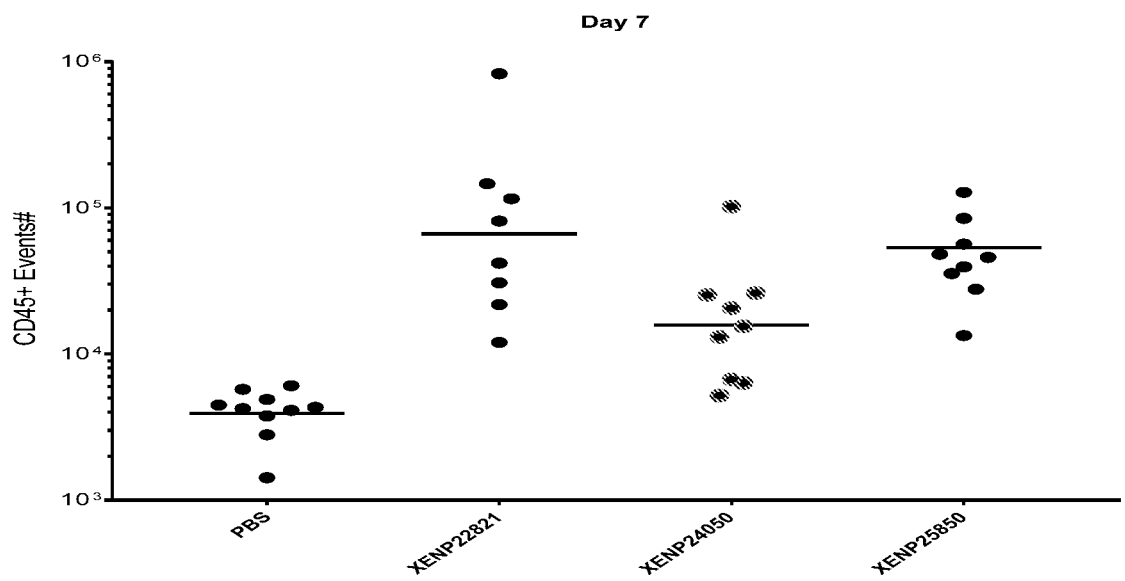
Figure 83C:
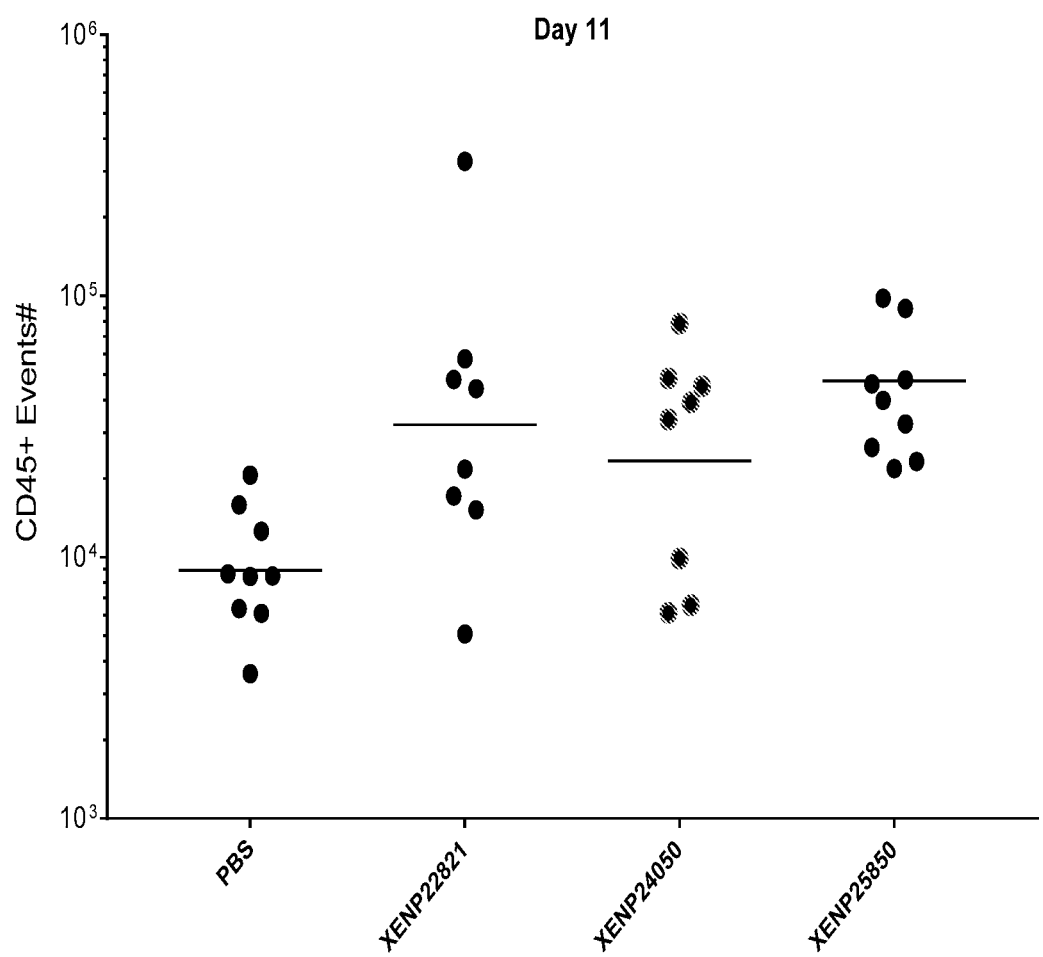

FIG. 83A-83C depicts CD45+ cell count on Days A) 4, B) 7, and C) 11 in whole blood of huPBMC engrafted mice following treatment with an illustrative IL-15/Rα×anti-PD-1 bifunctional protein XENP25850 and controls.

Figure 84A:
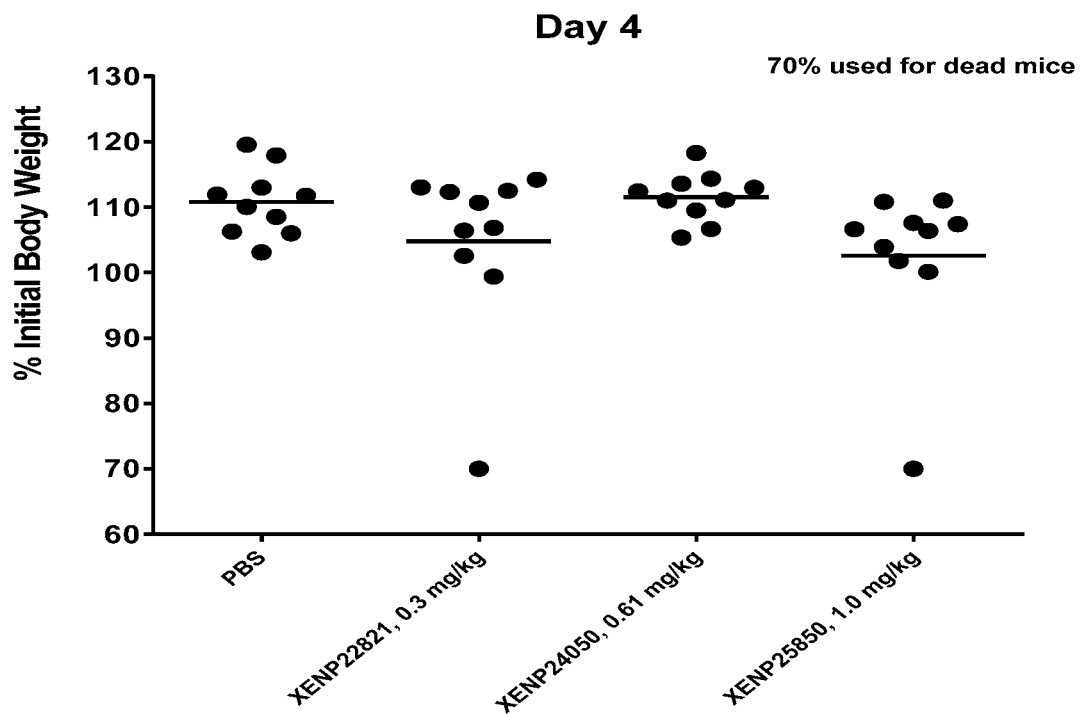
Figure 84B:
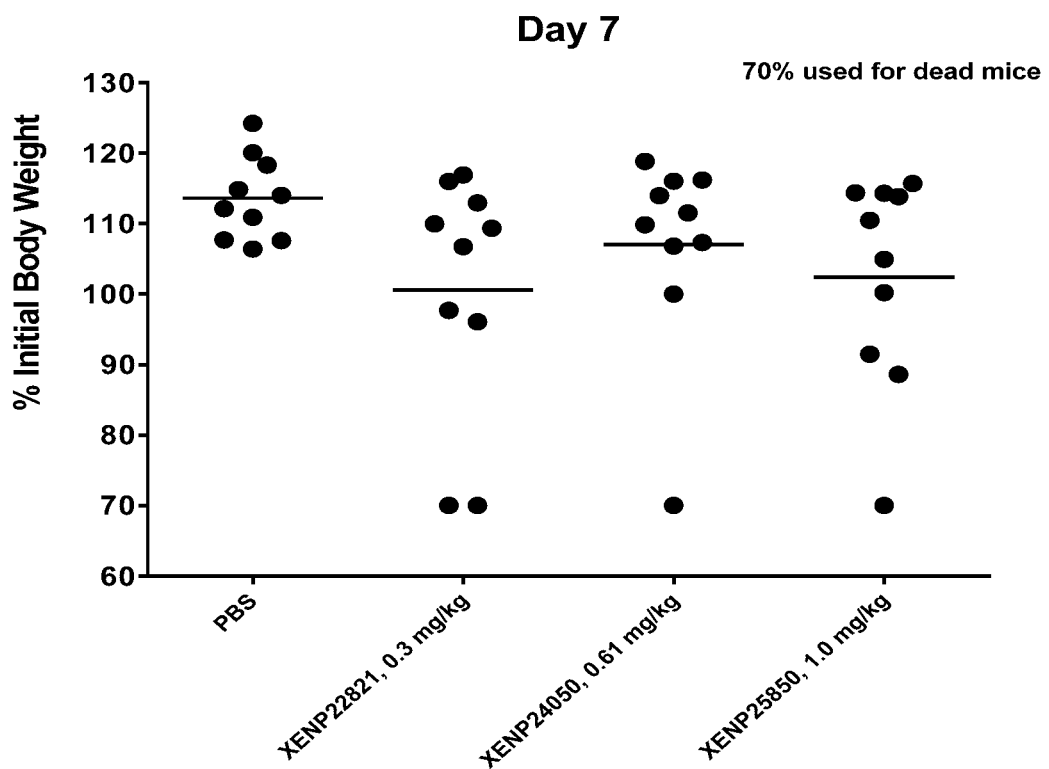
Figure 84C:
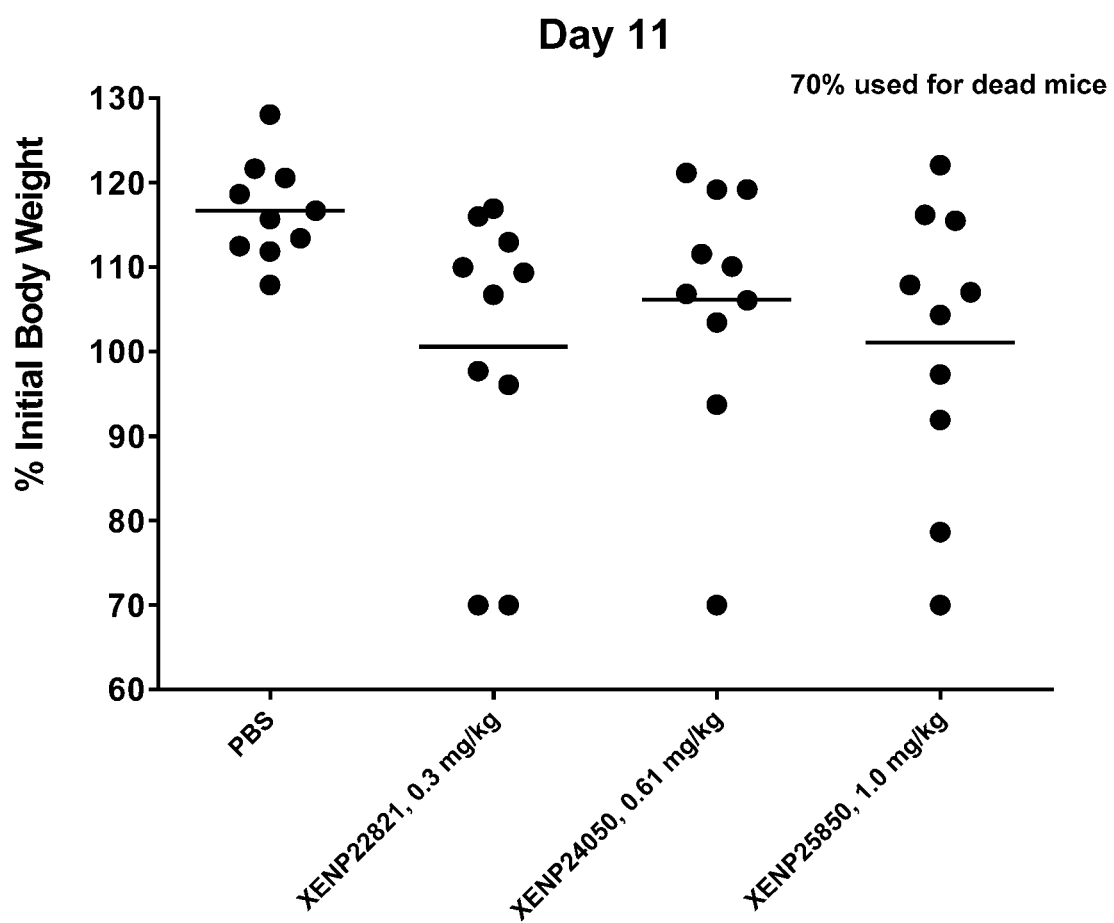

FIG. 84A-84C depicts the body weight as a percentage of initial body weight of huPBMC engrafted mice on Days A) 4, B) 7, and C) 11 following treatment with an illustrative IL-15/Rαxanti-PD-1 bifunctional protein XENP25850 and controls. Each point represents a single NSG mouse. Mice whose body weights dropped below 70% initial body weight were euthanized. Dead mice are represented as 70%.

FIG. 85A-85N depicts sequences of the invention. The CDRs are in bold, IL-15 and IL15-Rα(sushi) are underlined, linkers are double underlined, and slashes (/) are between IL-15, IL15-Rα(sushi), linkers, and Fc domains.

FIG. 86A-86F depicts additional anti-PD-1 Fv sequences from other sources that can find use in the present invention, either as a scFv construct (either in the vh-scFv linker-vl or vl-scFv linker-vh orientation) or as a Fab, and linked to the Fc domains as outlined herein, using optional domain linkers. As for most of the sequences depicted herein, the CDRs are underlined.

FIG. 87A-87B depicts sequences of particular use in the present invention, with FIG. 87A depicting a scFv IL-15/Rα(sushi) construct and FIG. 87b depicting the IL-15 and IL-15/Rα(sushi) with engineered cysteines.

FIG. 88 depicts a list of engineered heterodimer-skewing (e.g. "steric heterodimerization") Fc variants with heterodimer yields (determined by HPLC-CIEX) and thermal stabilities (determined by DSC). Not determined thermal stability is denoted by "n.d.".

DETAILED DESCRIPTION OF THE INVENTION

I. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Of particular use in the ablation of FcγR binding are those shown in FIG. 3. However, unless otherwise noted, the Fc monomers of the invention retain binding to the FcRn receptor.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "checkpoint antigen binding domain" binds a target checkpoint antigen as outlined herein. As is known in the art, these CDRs are generally present as a first set of variable heavy CDRs (vhCDRs or $V_H$CDRs) and a second set of variable light CDRs (vlCDRs or $V_L$CDR5), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. Thus, in some cases, the six CDRs of the antigen binding domain are contributed by a variable heavy and variable light chain. In a "Fab" format, the set of 6 CDRs are contributed by two different polypeptide sequences, the variable heavy domain (vh or $V_H$; containing the vhCDR1, vhCDR2 and vhCDR3) and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker as outlined herein, into a single polypeptide sequence, which can be either (starting from the N-terminus) vh-linker-vl or vl-linker-vh, with the former being generally preferred (including optional domain linkers on each side, depending on the format used (e.g., from FIG. 1 of U.S. 62/353,511).

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, -233E or 233E designates an insertion of glutamic acid after position 233 and before position 234. Additionally, -233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino acid sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides", for example the IgG1/2 hybrid can be included. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it.

Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and norleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein.

By "Fv" or "Fv fragment" or "Fv region" as used herein is meant a polypeptide that comprises the VL and VH domains of a single antibody. As will be appreciated by those in the art, these generally are made up of two chains, or can be combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh).

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants can be used to increase binding to the FcRn receptor, and in some cases, to increase serum half-life. In general, unless otherwise noted, the Fc monomers of the invention retain binding to the FcRn receptor (and, as noted below, can include amino acid variants to increase binding to the FcRn receptor).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the constant region of an antibody excluding the first constant region immunoglobulin domain (e.g., CH1) and in some cases, part of the hinge. Thus Fc refers to the last two constant region immunoglobulin domains (e.g., CH2 and CH3) of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

By "heavy constant region" herein is meant the CH1-hinge-CH2-CH3 portion of an antibody.

By "Fc fusion protein" or "immunoadhesin" herein is meant a protein comprising an Fc region, generally linked (optionally through a linker moiety, as described herein) to a different protein, such as to IL-15 and/or IL-15R, as described herein. In some instances, two Fc fusion proteins can form a homodimeric Fc fusion protein or a heterodimeric Fc fusion protein with the latter being preferred. In some cases, one monomer of the heterodimeric Fc fusion protein comprises an Fc domain alone (e.g., an empty Fc domain) and the other monomer is a Fc fusion, comprising a variant Fc domain and a protein domain, such as a receptor, ligand or other binding partner.

By "position" as used herein is meant a location in the sequence of a protein. Positions may be numbered sequentially, or according to an established format, for example the EU index for antibody numbering.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "target antigen" as used herein is meant the molecule that is bound specifically by the variable region of a given antibody. A target antigen may be a protein, carbohydrate, lipid, or other chemical compound. A wide number of suitable target antigens are described below.

By "target cell" as used herein is meant a cell that expresses a target antigen.

By "variable region" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

The biospecific heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to a protein which is substantially free of other proteins having different binding specificities. "Recombinant" means the proteins are generated using recombinant nucleic acid techniques in exogenous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore assay.

II. Introduction

The invention provides heterodimeric fusion proteins that can bind to the checkpoint inhibitor PD-1 antigen and can complex with the common gamma chain (γc; CD132) and/or the Il-2 receptor β-chain (IL-2Rβ; CD122). In general, the heterodimeric fusion proteins of the invention have three functional components: an IL-15/IL-15Rα(sushi) component, generally referred to herein as an "IL-15 complex", an anti-PD-1 component, and an Fc component, each of which can take different forms and each of which can be combined with the other components in any configuration.

A. IL-15/IL-15Rα(Sushi) Domains

As shown in the figures, the IL-15 complex can take several forms. As stated above, the IL-15 protein on its own is less stable than when complexed with the IL-15Rα protein. As is known in the art, the IL-15Rα protein contains a "sushi domain", which is the shortest region of the receptor that retains IL-15 binding activity. Thus, while heterodimeric fusion proteins comprising the entire IL-15Rα protein can be made, preferred embodiments herein include complexes that just use the sushi domain, the sequence of which is shown in the figures.

Figure 64A:
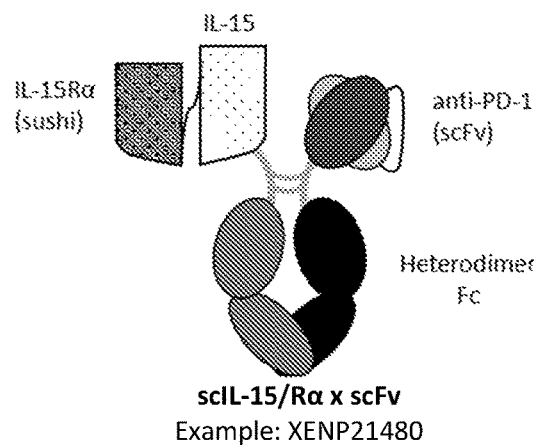
Figure 64B:
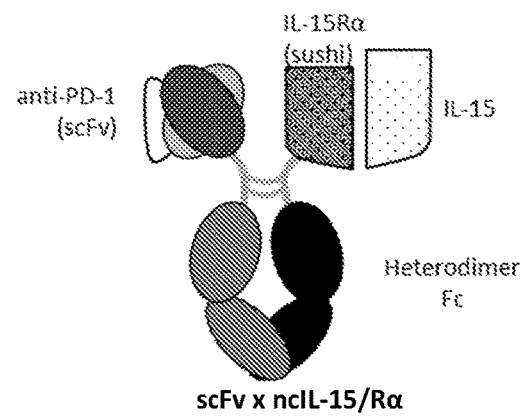

Accordingly, the IL-15 complex generally comprises the IL-15 protein and the sushi domain of IL IL-15Rα (unless otherwise noted that the full length sequence is used, "IL-15Rα", "IL-15Rα(sushi)" and "sushi" are used interchangeably throughout). This complex can be used in three different formats. As shown in FIG. 64B, the IL-15 protein and the IL-15Rα(sushi) are not covalently attached, but rather are self-assembled through regular ligand-ligand interactions. As is more fully described herein, it can be either the IL-15 domain or the sushi domain that is covalently linked to the Fc domain (generally using an optional domain linker). Alternatively, they can be covalently attached using a domain linker as generally shown in FIG. 64A. FIG. 64A depicts the sushi domain as the N-terminal domain, although this can be reversed. Finally, each of the IL-15 and sushi domains can be engineered to contain a cysteine amino acid, that forms a disulfide bond to form the complex as is generally shown in FIG. 64C, again, with either the IL-15 domain or the sushi domain being covalently attached (using an optional domain linker) to the Fc domain.

B. Anti-PD-1 Components

The anti-PD-1 component (the anti-PD-1 antigen binding domain or ABD) of the invention is generally a set of 6 CDRs and/or a variable heavy domain and a variable light domain that form an Fv domain that can bind human PD-1. As shown herein, the anti-PD-1 ABD can be in the form of a scFv, wherein the vh and vl domains are joined using an scFv linker, which can be optionally a charged scFv linker. As will be appreciated by those in the art, the scFv can be assembled from N- to C-terminus as N-vh-scFv linker-vl-C or as N-vl-scFv linker-vh-C, with the C terminus of the scFv domain generally being linked to the hinge-CH2-CH3 Fc domain. Suitable Fvs (including CDR sets and variable heavy/variable light domains) can be used in scFv formats or Fab formats as shown in the Figures as well as disclosed in U.S. 62/353,511, the contents are hereby incorporated in its entirety for all purposes, and in particular for the FIGS. 11 and 12 sequences.

As will further be appreciated by those in the art, all or part of the hinge (which can also be a wild type hinge from IgG1, IgG2 or IgG4 or a variant thereof, such as the IgG4 S241P or S228P hinge variant with the substitution proline at position 228 relative to the parent IgG4 hinge polypeptide (wherein the numbering S228P is according to the EU index and the S241P is the Kabat numbering)) can be used as the domain linker between the scFv and the CH2-CH3 domain, or a different domain linker such as depicted in the Figures can be used.

C. Fc Domains

The Fc domain component of the invention is as described herein, which generally contains skew variants and/or optional pI variants and/or ablation variants are outlined herein.

III. Bispecific IL-15/IL-15Rα Fc Fusion×PD-1 ABD Heterodimeric Proteins

Provided herein are heterodimeric fusion proteins that can bind to the checkpoint inhibitor PD-1 antigen and can complex with the common gamma chain (γc; CD132) and/or the Il-2 receptor β-chain (IL-2Rβ; CD122). The heterodimeric fusion proteins can contain an IL-15/IL-15Rα-Fc fusion protein and an antibody fusion protein. The IL-15/IL-15Rα-Fc fusion protein can include as IL-15 protein covalently attached to an IL-15Rα, and an Fc domain. Optionally, the IL-15 protein and IL-15Rα protein are noncovalently attached.

The Fc domains can be derived from IgG Fc domains, e.g., IgG1, IgG2, IgG3 or IgG4 Fc domains, with IgG1 Fc domains finding particular use in the invention. The following describes Fc domains that are useful for IL-15/IL-15Rα Fc fusion monomers and checkpoint antibody fragments of the bispecific heterodimer proteins of the present invention.

The carboxy-terminal portion of each chain defines a constant region primarily responsible for effector function Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

Thus, the present invention provides different antibody domains, e.g, different Fc domains. As described herein and known in the art, the heterodimeric proteins of the invention comprise different domains, which can be overlapping as well. These domains include, but are not limited to, the Fc domain, the CH1 domain, the CH2 domain, the CH3 domain, the hinge domain, and the heavy constant domain (CH1-hinge-Fc domain or CH1-hinge-CH2-CH3).

Thus, the "Fc domain" includes the —CH2-CH3 domain, and optionally a hinge domain, and can be from human IgG1, IgG2, IgG3 or IgG4, with Fc domains derived from IgG1. In some of the embodiments herein, when a protein fragment, e.g., IL-15 or IL-15Rα is attached to an Fc domain, it is the C-terminus of the IL-15 or IL-15Rα construct that is attached to all or part of the hinge of the Fc domain; for example, it is generally attached to the sequence EPKS (SEQ ID NO: 15) which is the beginning of the hinge. In other embodiments, when a protein fragment, e.g., IL-15 or IL-15Rα, is attached to an Fc domain, it is the C-terminus of the IL-15 or IL-15Rα construct that is attached to the CH1 domain of the Fc domain.

In some of the constructs and sequences outlined herein of an Fc domain protein, the C-terminus of the IL-15 or IL-15Rα protein fragment is attached to the N-terminus of a domain linker, the C-terminus of which is attached to the N-terminus of a constant Fc domain (N-IL-15 or IL-15Rα protein fragment-linker-Fc domain-C) although that can be switched (N-Fc domain-linker-IL-15 or IL-15Rα protein fragment-C). In other constructs and sequence outlined herein, C-terminus of a first protein fragment is attached to the N-terminus of a second protein fragment, optionally via a domain linker, the C-terminus of the second protein fragment is attached to the N-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

In some embodiments, the linker is a "domain linker", used to link any two domains as outlined herein together, some of which are depicted in FIG. 8. While any suitable linker can be used, many embodiments utilize a glycine-serine polymer, including for example (GS)n (SEQ ID NO: 7), (GSGGS)n (SEQ ID NO: 8), (GGGGS)n (SEQ ID NO: 9), and (GGGS)n (SEQ ID NO: 10), where n is an integer of at least one (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers.

In one embodiment, heterodimeric Fc fusion proteins contain at least two constant domains which can be engineered to produce heterodimers, such as pI engineering.

Other Fc domains that can be used include fragments that contain one or more of the CH1, CH2, CH3,and hinge domains of the invention that have been pI engineered. In particular, the formats depicted in FIG. 21 and FIG. 64 are heterodimeric Fc fusion proteins, meaning that the protein has two associated Fc sequences self-assembled into a heterodimeric Fc domain and at least one protein fragment (e.g., 1, 2 or more protein fragments) as more fully described below. In some cases, a first protein fragment is linked to a first Fc sequence and a second protein fragment is linked to a second Fc sequence. In other cases, a first protein fragment is linked to a first Fc sequence, and the first protein fragment is non-covalently attached to a second protein fragment that is not linked to an Fc sequence. In some cases, the heterodimeric Fc fusion protein contains a first protein fragment linked to a second protein fragment which is linked a first Fc sequence, and a second Fc sequence that is not linked to either the first or second protein fragments.

Accordingly, in some embodiments the present invention provides heterodimeric Fc fusion proteins that rely on the use of two different heavy chain variant Fc sequences, that will self-assemble to form a heterodimeric Fc domain fusion polypeptide.

The present invention is directed to novel constructs to provide heterodimeric Fc fusion proteins that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (e.g. aspartic acid to lysine) or changing a charged residue to a neutral residue (e.g., loss of a charge; lysine to serine). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A−+B or wt A−−B), or by increasing one region and decreasing the other region (A+−B− or A−B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. As is known in the art, different Fcs will have different starting pIs which are exploited in the present invention. In general, as outlined herein, the pIs are engineered to result in a total pI difference of each monomer of at least about 0.1 logs, with 0.2 to 0.5 being preferred as outlined herein.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

A. Heterodimerization Variants

The present invention provides heterodimeric proteins, including heterodimeric Fc fusion proteins in a variety of formats, which utilize heterodimeric variants to allow for heterodimeric formation and/or purification away from homodimers. The heterodimeric fusion constructs are based on the self-assembling nature of the two Fc domains, e.g., two "monomers" that assemble into a "dimer". **Robin There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the FIG. 29 of U.S. Ser. No. 15/141,350, all of which is hereby incorporated by reference in its entirety, as well as in FIGS. 1A-1E.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 3. Of particular use in many embodiments are the pairs of sets including, but not limited to, S364K/E357Q:L368D/K370S; L368D/K370S:S364K; L368E/K370S:S364K; T411E/K360E/Q362E:D401K; L368D/K370S:S364K/E357L, K370S:S364K/E357Q and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 30 of U.S. Ser. No. 15/141,350, all of which are herein incorporated by reference in its entirety. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgG1) if one of the Fc monomers includes a CH1 domain. In some instances, the second monomer comprising a positively charged domain linker, including (GKPGS)$_4$ (SEQ ID NO: 5). In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgG1).

In some embodiments, mutations are made in the hinge domain of the Fc domain, including positions 221, 222, 223, 224, 225, 233, 234, 235 and 236. It should be noted that changes in 233-236 can be made to increase effector function (along with 327A) in the IgG2 backbone. Thus, pI mutations and particularly substitutions can be made in one or more of positions 221-225, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 274, 296, 300, 309, 320, 322, 326, 327, 334 and 339. Again, all possible combinations of these 10 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, and all possible combinations within CH2 and with other domains.

In this embodiment, the mutations can be independently and optionally selected from position 355, 359, 362, 384, 389, 392, 397, 418, 419, 444 and 447. Specific substitutions that find use in lowering the pI of CH3 domains include, but are not limited to, a non native glutamine or glutamic acid at position 355, a non-native serine at position 384, a non-native asparagine or glutamic acid at position 392, a non-native methionine at position 397, a non native glutamic acid at position 419, a non native glutamic acid at position 359, a non native glutamic acid at position 362, a non native glutamic acid at position 389, a non native glutamic acid at position 418, a non native glutamic acid at position 444, and a deletion or non-native aspartic acid at position 447. Exemplary embodiments of pI variants are provided in FIG. 2.

D. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. App. No. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

E. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Publ. App. No. 2014/0370013. As discussed herein, which monomer to engineer is generally decided by the inherent pI of each monomer.

F. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half-life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

G. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

H. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), U.S. Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

I. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific immunomodulatory antibodies desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. It should be noted that the ablation variants referenced herein ablate FcγR binding but generally not FcRn binding.

Exemplary embodiments of pI variants are provided in FIG. 3.

J. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411E/K360E/Q362E:D401K; L368D/K370S: S364K/E357L, K370S:S364K/E357Q, T366S/L368A/Y407V:T366W and T366S/L368A/Y407V/Y349C:T366W/S354C, optionally ablation variants, optionally charged domain linkers and the heavy chain comprises pI variants.

In some embodiments, the Fc domain comprising an amino acid substitution selected from the group consisting of: 236R, 239D, 239E, 243L, M252Y, V259I, 267D, 267E, 298A, V308F, 328F, 328R, 330L, 332D, 332E, M428L, N434A, N434S, 236R/328R, 239D/332E, M428L, 236R/328F, V259I/V308F, 267E/328F, M428L/N434S, Y436I/M428L, Y436V/M428L, Y436I/N434S, Y436V/N434S, 239D/332E/330L, M252Y/S254T/T256E, V259I/V308F/M428L, E233P/L234V/L235A/G236del/S267K, G236R/L328R and PVA/S267K. In some cases, the Fc domain comprises the amino acid substitution 239D/332E. In other cases, the Fc domain comprises the amino acid substitution G236R/L328R or PVA/S267K.

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprises Q295E/N384D/Q418E/N481D and the other a positively charged domain linker. As will be appreciated in the art, the "knobs in holes" variants do not change pI, and thus can be used on either monomer.

IV. Useful Formats of the Invention

As shown in FIG. 64, there are a number of useful formats of the bispecific heterodimeric fusion proteins of the invention. In general, the heterodimeric fusion proteins of the invention have three functional components: an IL-15/IL-15Rα(sushi) component, an anti-PD-1 component, and an Fc component, each of which can take different forms as outlined herein and each of which can be combined with the other components in any configuration.

The first and the second Fc domains can have a set of amino acid substitutions selected from the group consisting of a) S267K/L368D/K370S:S267K/S364K/E357Q; b) S364K/E357Q:L368D/K370S; c) L368D/K370S:S364K; d) L368E/K370S:S364K; e) T411E/K360E/Q362E:D401K; f) L368D/K370S:S364K/E357L and g) K370S:S364K/E357Q, according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

Optionally, the first and/or second Fc domains have 428L/4345 variants for half life extension.

A. scIL-15/RαxscFv

One embodiment is shown in FIG. 64A, and comprises two monomers. The first monomer comprises, from N- to C-terminus, the sushi domain-domain linker-Il-15-domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. This is generally referred to as "scIL-15/RαxscFv", with the "sc" standing for "single chain" referring to the attachment of the IL-15 and suchi domain using a covalent linker. Preferred combinations of variants for this embodiment are found in FIGS. 7A and B.

In the scIL-15/RαxscFv format, one preferred embodiment utilizes the anti-PD-1 ABD having the sequence 1G6_L1.194_H1.279 as shown in FIG. 14.

In the scIL-15/RαxscFv format, one preferred embodiment utilizes the skew variant pair S364K/E357Q:L368D/K370S.

In the scIL-15/RαxscFv format, one preferred embodiment utilizes the anti-PD-1 ABD having the sequence 1G6_L1.194_H1.279 as shown in FIG. 14 and the skew variant pair S364K/E357Q:L368D/K370S.

In the scIL-15/RαxscFv format, one preferred embodiment utilizes the anti-PD-1 ABD having the sequence 1G6_L1.194_H1.279 as shown in FIG. 14, in the FIG. 7A format: e.g. the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In the scIL-15/RαxscFv format, one preferred embodiment utilizes the anti-PD-1 ABD having the sequence 1G6_L1.194_H1.279 as shown in FIG. 14, in the FIG. 7B format.

In the scIL-15/RαxscFv format, one preferred embodiment utilizes the anti-PD-1 ABD having the variable heavy and variable light sequences from 1C11[PD-1]_H3L3 as shown in FIG. 14.

In the scIL-15/RαxscFv format, one preferred embodiment utilizes the anti-PD-1 ABD having the sequence 1C11[PD-1]_H3L3 as shown in FIG. 14 in the FIG. 7A format.

In the scIL-15/RαxscFv format, one preferred embodiment utilizes the anti-PD-1 ABD having the sequence 1C11[PD-1]_H3L3 as shown in FIG. 14 in the FIG. 7B format.

In the scIL-15/RαxscFv format, one preferred embodiment utilizes the anti-PD-1 ABD having an Fv sequence as depicted in FIG. 86.

In the scIL-15/RαxscFv format, one preferred embodiment utilizes the IL-15 complex (sushi domain-linker-IL-15) as depicted in FIG. 87A.

In the scIL-15/RαxscFv format, one preferred embodiment utilizes the anti-PD-1 ABD having the sequence 1G6_L1.194_H1.279 as shown in FIG. 14 and the IL-15 complex (sushi domain-linker-IL-15) as depicted in FIG. 87A.

B. scFvxncIL-15/Rα

This embodiment is shown in FIG. 64B, and comprises three monomers. The first monomer comprises, from N- to C-terminus, the sushi domain-domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. The third monomer is the IL-15 domain. This is generally referred to as "ncIL-15/RαxscFv" or "scFvxncIL-15/Rα" with the "nc" standing for "non-covalent" referring to the self-assembling non-covalent attachment of the IL-15 and suchi domain. Preferred combinations of variants for this embodiment are found in FIGS. 7A and B.

In the ncIL-15/RαxscFv format, one preferred embodiment utilizes the anti-PD-1 ABD having the sequence 1G6_L1.194_H1.279 as shown in FIG. 14.

In the ncIL-15/RαxscFv format, one preferred embodiment utilizes the skew variant pair S364K/E357Q:L368D/K370S.

In the ncIL-15/RαxscFv format, one preferred embodiment utilizes the anti-PD-1 ABD having the sequence 1G6_L1.194_H1.279 as shown in FIG. 14 and the skew variant pair S364K/E357Q:L368D/K370S.

In the ncIL-15/RαxscFv format, one preferred embodiment utilizes the anti-PD-1 ABD having the sequence 1G6_L1.194_H1.279 as shown in FIG. 14, in the FIG. 7A format: e.g. the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In the ncIL-15/RαxscFv format, one preferred embodiment utilizes the anti-PD-1 ABD having the sequence 1G6_L1.194_H1.279 as shown in FIG. 14, in the FIG. 7B format.

In the ncIL-15/RαxscFv format, one preferred embodiment utilizes the anti-PD-1 ABD having the variable heavy and light sequences from 1C11[PD-1]_H3L3 as shown in FIG. 14.

In the ncIL-15/RαxscFv format, one preferred embodiment utilizes the anti-PD-1 ABD having the sequence 1C11 [PD-1]_H3L3 as shown in FIG. 14 in the FIG. 7A format.

In the ncIL-15/RαxscFv format, one preferred embodiment utilizes the anti-PD-1 ABD having the sequence 1C11 [PD-1]_H3L3 as shown in FIG. 14 in the FIG. 7B format.

In the ncIL-15/RαxscFv format, one preferred embodiment utilizes the anti-PD-1 ABD having an Fv sequence as depicted in FIG. 86.

In the scIL-15/RαxscFv format, one preferred embodiment utilizes the anti-PD-1 ABD having the sequence 1G6_L1.194_H1.279 as shown in FIG. 14 and the IL-15 complex (sushi domain and IL-15) as depicted in FIG. 87B.

C. scFvxdsIL-15/Rα

Figure 64C:
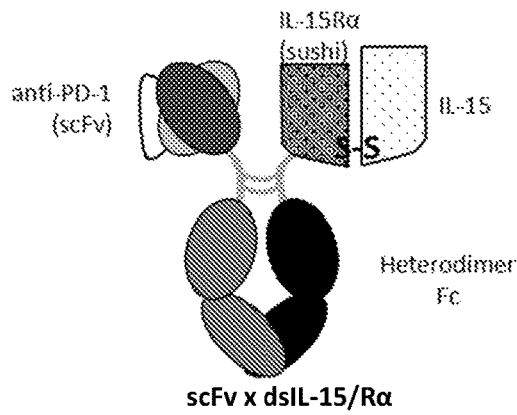

This embodiment is shown in FIG. 64C, and comprises three monomers. The first monomer comprises, from N- to C-terminus, the sushi domain-domain linker-CH2-CH3, wherein the sushi domain has an engineered cysteine residue and the second monomer comprises vh-scFv linker-vl-hinge-CH2-CH3 or vl-scFv linker-vh-hinge-CH2-CH3, although in either orientation a domain linker can be substituted for the hinge. The third monomer is the IL-15 domain, also engineered to have a cysteine variant amino acid, thus allowing a disulfide bridge to form between the sushi domain and the IL-15 domain. This is generally referred to as "scFvxdsIL-15/Rα" or dsIL-15/RαxscFv, with the "ds" standing for "disulfide". Preferred combinations of variants for this embodiment are found in FIGS. 7A and B.

In the dsIL-15/RαxscFv format, one preferred embodiment utilizes the skew variant pair S364K/E357Q:L368D/K370S.

In the dsIL-15/RαxscFv format, one preferred embodiment utilizes the anti-PD-1 ABD having the sequence 1G6 L1.194_H1.279 as shown in FIG. 14.

In the dsIL-15/RαxscFv format, one preferred embodiment utilizes the skew variant pair S364K/E357Q:L368D/K370S and the anti-PD-1 ABD having the sequence 1G6_L1.194_H1.279 as shown in FIG. 14.

In the dsIL-15/RαxscFv format, one preferred embodiment utilizes the anti-PD-1 ABD having the sequence 1G6_L1.194_H1.279 as shown in FIG. 14, in the FIG. 7A format: e.g. the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In the dsIL-15/RαxscFv format, one preferred embodiment utilizes the anti-PD-1 ABD having the sequence 1G6 L1.194_H1.279 as shown in FIG. 14, in the FIG. 7B format.

In the dsIL-15/RαxscFv format, one preferred embodiment utilizes the anti-PD-1 ABD having the sequence 1C11 [PD-1]_H3L3 as shown in FIG. 14.

In the dsIL-15/RαxscFv format, one preferred embodiment utilizes the anti-PD-1 ABD having the sequence 1C11 [PD-1]_H3L3 as shown in FIG. 14 in the FIG. 7A format.

In the dsIL-15/RαxscFv format, one preferred embodiment utilizes the anti-PD-1 ABD having the sequence 1C11 [PD-1]_H3L3 as shown in FIG. 14 in the FIG. 7B format.

In the dsIL-15/RαxscFv format, one preferred embodiment utilizes the anti-PD-1 ABD having an Fv sequence as depicted in FIG. 86.

D. scIL-15/RαxFab

Figure 64D:
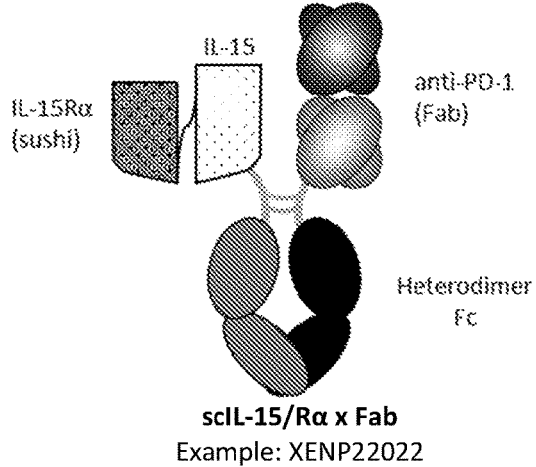

This embodiment is shown in FIG. 64D, and comprises three monomers. The first monomer comprises, from N- to C-terminus, the sushi domain-domain linker-IL-15-domain linker-CH2-CH3 and the second monomer comprises a heavy chain, VH-CH1-hinge-CH2-CH3. The third monomer is a light chain, VL-CL. This is generally referred to as "scIL-15/RαxFab", with the "sc" standing for "single chain". Preferred combinations of variants for this embodiment are found in FIG. 7C.

In the scIL-15/RαxFab format, one preferred embodiment utilizes the skew variant pair S364K/E357Q:L368D/K370S.

In the scIL-15/RαxFab format, one preferred embodiment utilizes the anti-PD-1 ABD having the sequence 1G6_L1.194_H1.279 as shown in FIG. 14.

In the scIL-15/RαxFab format, one preferred embodiment utilizes the anti-PD-1 ABD having the sequence 1G6_L1.194_H1.279 as shown in FIG. 14, in the FIG. 7A format: e.g. the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In the scIL-15/RαxFab format, one preferred embodiment utilizes the anti-PD-1 ABD having the sequence 1G6_L1.194_H1.279 as shown in FIG. 14, in the FIG. 7C format.

In the scIL-15/RαxFab format, one preferred embodiment utilizes the anti-PD-1 ABD having the sequence 1G6_L1.194_H1.279 as shown in FIG. 14 and the skew variant pair S364K/E357Q:L368D/K370S.

In the scIL-15/RαxFab format, one preferred embodiment utilizes the anti-PD-1 ABD having the sequence 1C11 [PD-1]_H3L3 as shown in FIG. 14.

In the scIL-15/RαxFab format, one preferred embodiment utilizes the anti-PD-1 ABD having the sequence 1C11 [PD-1]_H3L3 as shown in FIG. 14 in the FIG. 7C format.

In the scIL-15/RαxFab format, one preferred embodiment utilizes the anti-PD-1 ABD having the sequence 1C11 [PD-1]_H3L3 as shown in FIG. 14 in the FIG. 7C format.

In the scIL-15/RαxFab format, one preferred embodiment utilizes the anti-PD-1 ABD having an Fv sequence as depicted in FIG. 86.

In the scIL-15/RαxFab format, one preferred embodiment utilizes the IL-15 complex sequences depicted in FIG. 87A.

In the scIL-15/RαxFab format, one preferred embodiment utilizes the anti-PD-1 ABD having the sequence 1G6_L1.194_H1.279 as shown in FIG. 14 and the IL-15 complex (sushi domain-linker-IL-15) as depicted in FIG. 87A.

E. FabxncIL-15/Rα

Figure 64E:
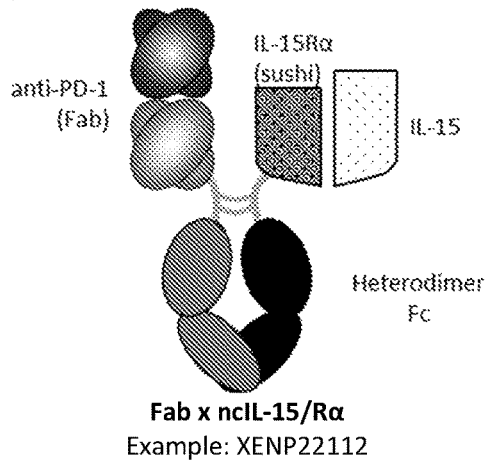

This embodiment is shown in FIG. 64E, and comprises three monomers. The first monomer comprises, from N- to C-terminus, the sushi domain-domain linker-CH2-CH3, and the second monomer comprises a heavy chain, VH-CH1-hinge-CH2-CH3. The third monomer is the IL-15 domain. This is generally referred to as "FabxncIL-15/Rα", with the "nc" standing for "non-covalent" referring to the self-assembling non-covalent attachment of the IL-15 and suchi domain. Preferred combinations of variants for this embodiment are found in FIG. 7D.

In the FabxncIL-15/Rα format, one preferred embodiment utilizes the skew variant pair S364K/E357Q:L368D/K370S.

In the FabxncIL-15/Rα format, one preferred embodiment utilizes the anti-PD-1 ABD having the sequence 1G6_L1.194_H1.279 as shown in FIG. 14.

In the Fab×ncIL-15/Rα format, one preferred embodiment utilizes the anti-PD-1 ABD having the sequence 1G6_L1.194_H1.279 as shown in FIG. 14, in the FIG. 7D format.

In the Fab×ncIL-15/Rα format, one preferred embodiment utilizes the anti-PD-1 ABD having the sequence 1G6_L1.194_H1.279 as shown in FIG. 14, in the FIG. 7D format.

In the Fab×ncIL-15/Rα format, one preferred embodiment utilizes the anti-PD-1 ABD having the sequence 1C11 [PD-1]_H3L3 as shown in FIG. 14 and the skew variant pair S364K/E357Q:L368D/K370S.

In the Fab×ncIL-15/Rα format, one preferred embodiment utilizes the anti-PD-1 ABD having the sequence 1C11 [PD-1]_H3L3 as shown in FIG. 14 in the FIG. 7D format.

In the Fab×ncIL-15/Rα format, one preferred embodiment utilizes the anti-PD-1 ABD having the sequence 1C11 [PD-1]_H3L3 as shown in FIG. 14 in the FIG. 7D format.

In the Fab×ncIL-15/Rα format, one preferred embodiment utilizes the anti-PD-1 ABD having an Fv sequence as depicted in FIG. 86.

F. Fab×dsIL-15/Rα

Figure 64F:
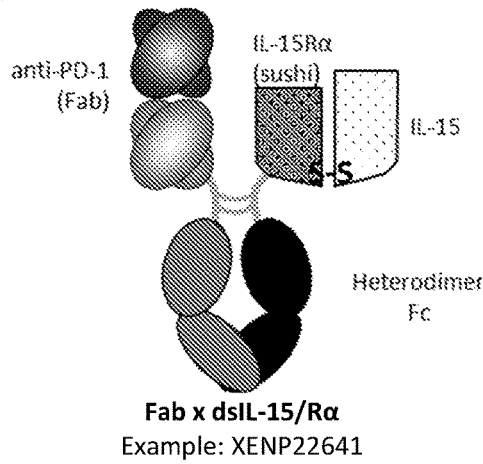

This embodiment is shown in FIG. 64F, and comprises three monomers. The first monomer comprises, from N- to C-terminus, the sushi domain-domain linker-CH2-CH3, wherein the sushi domain has been engineered to contain a cysteine residue, and the second monomer comprises a heavy chain, VH-CH1-hinge-CH2-CH3. The third monomer is the IL-15 domain, also engineered to have a cysteine residue, such that a disulfide bridge is formed under native cellular conditions. This is generally referred to as "Fab× dsIL-15/Rα", with the "ds" standing for "disulfide" referring to the self-assembling non-covalent attachment of the IL-15 and suchi domain. Preferred combinations of variants for this embodiment are found in FIG. 7.

In the dsIL-15/Rα×Fab format, one preferred embodiment utilizes the skew variant pair S364K/E357Q:L368D/K370S.

In the Fab×dsIL-15/Rα format, one preferred embodiment utilizes the anti-PD-1 ABD having the sequence 1G6_L1.194_H1.279 as shown in FIG. 14.

In the Fab×dsIL-15/Rα format, one preferred embodiment utilizes the anti-PD-1 ABD having the sequence 1G6_L1.194_H1.279 as shown in FIG. 14, in the FIG. 7D format.

In the Fab×dsIL-15/Rα format, one preferred embodiment utilizes the anti-PD-1 ABD having the sequence 1G6_L1.194_H1.279 as shown in FIG. 14, in the FIG. 7D format.

In the Fab×dsIL-15/Rα format, one preferred embodiment utilizes the anti-PD-1 ABD having the sequence 1C11 [PD-1]_H3L3 as shown in FIG. 14.

In the Fab×dsIL-15/Rα format, one preferred embodiment utilizes the anti-PD-1 ABD having the sequence 1C11 [PD-1]_H3L3 as shown in FIG. 14 and the skew variant pair S364K/E357Q:L368D/K370S.

In the Fab×dsIL-15/Rα format, one preferred embodiment utilizes the anti-PD-1 ABD having the sequence 1C11 [PD-1]_H3L3 as shown in FIG. 14 in the FIG. 7D format.

In the Fab×dsIL-15/Rα format, one preferred embodiment utilizes the anti-PD-1 ABD having the sequence 1C11 [PD-1]_H3L3 as shown in FIG. 14 in the FIG. 7D format.

In the Fab×dsIL-15/Rα format, one preferred embodiment utilizes the anti-PD-1 ABD having an Fv sequence as depicted in FIG. 86.

In the Fab×dsIL-15/Rα format, one preferred embodiment utilizes the IL-15 complex sequences depicted in FIG. 87B.

G. mAb-scIL-15/Rα

Figure 64G:
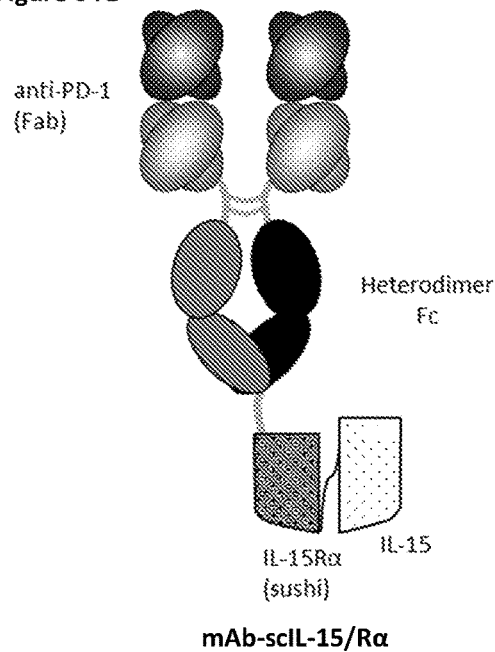

This embodiment is shown in FIG. 64G, and comprises three monomers (although the fusion protein is a tetramer). The first monomer comprises a heavy chain, VH-CH1-hinge-CH2-CH3. The second monomer comprises a heavy chain with a scIL-15 complex, VH-CH1-hinge-CH2-CH3-domain linker-sushi domain-domain linker-IL-15. The third (and fourth) monomer are light chains, VL-CL. This is generally referred to as "mAb-scIL-15/Rα", with the "sc" standing for "single chain". Preferred combinations of variants for this embodiment are found in FIG. 7.

In the mAb-scIL-15/Rα format, one preferred embodiment utilizes the anti-PD-1 ABD having the sequence 1G6_L1.194_H1.279 as shown in FIG. 14.

In the mAb-scIL-15/Rα format, one preferred embodiment utilizes the skew variant pair S364K/E357Q:L368D/K370S.

In the mAb-scIL-15/Rα format, one preferred embodiment utilizes the anti-PD-1 ABD having the sequence 1G6_L1.194_H1.279 as shown in FIG. 14, in the FIG. 7A format.

In the mAb-scIL-15/Rα format, one preferred embodiment utilizes the anti-PD-1 ABD having the sequence 1G6_L1.194_H1.279 as shown in FIG. 14, in the FIG. 7C format.

In the mAb-scIL-15/Rα format, one preferred embodiment utilizes the anti-PD-1 ABD having the sequence 1C11 [PD-1]_H3L3 as shown in FIG. 14.

In the mAb-scIL-15/Rα format, one preferred embodiment utilizes the anti-PD-1 ABD having the sequence 1C11 [PD-1]_H3L3 as shown in FIG. 14 and the skew variant pair S364K/E357Q:L368D/K370S.

In the mAb-scIL-15/Rα format, one preferred embodiment utilizes the anti-PD-1 ABD having the sequence 1C11 [PD-1]_H3L3 as shown in FIG. 14 in the FIG. 7C format.

In the mAb-scIL-15/Rα format, one preferred embodiment utilizes the anti-PD-1 ABD having the sequence 1C11 [PD-1]_H3L3 as shown in FIG. 14 in the FIG. 7C format.

In the mAb-scIL-15/Rα format, one preferred embodiment utilizes the anti-PD-1 ABD having an Fv sequence as depicted in FIG. 86.

In the mAb-scIL-15/Rα format, one preferred embodiment utilizes the IL-15 complex sequences depicted in FIG. 87A.

H. mAb-ncIL-15/Rα

Figure 64H:
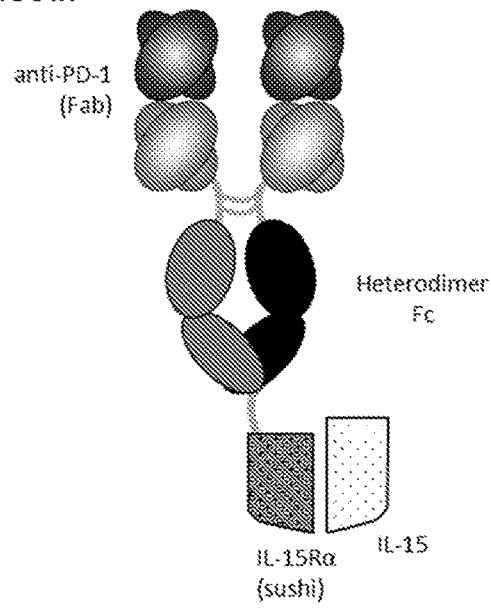

This embodiment is shown in FIG. 64H, and comprises four monomers (although the heterodimeric fusion protein is a pentamer). The first monomer comprises a heavy chain, VH-CH1-hinge-CH2-CH3. The second monomer comprises a heavy chain with an IL-15Rα(sushi) domain, VH-CH1-hinge-CH2-CH3-domain linker-sushi domain. The third monomer is an IL-15 domain. The fourth (and fifth) monomer are light chains, VL-CL. This is generally referred to as "mAb-ncIL-15/Rα", with the "nc" standing for "non-covalent". Preferred combinations of variants for this embodiment are found in FIG. 7.

In the mAb-ncIL-15/Rα format, one preferred embodiment utilizes the anti-PD-1 ABD having the sequence 1G6_L1.194_H1.279 as shown in FIG. 14.

In the mAb-ncIL-15/Rα format, one preferred embodiment utilizes the skew variant pair S364K/E357Q:L368D/K370S.

In the mAb-ncIL-15/Rα format, one preferred embodiment utilizes the anti-PD-1 ABD having the sequence 1G6_L1.194_H1.279 as shown in FIG. 14, in the FIG. 7 format.

In the mAb-ncIL-15/Rα format, one preferred embodiment utilizes the anti-PD-1 ABD having the sequence 1G6_L1.194_H1.279 as shown in FIG. 14, in the FIG. 7 format.

In the mAb-ncIL-15/Rα format, one preferred embodiment utilizes the anti-PD-1 ABD having the sequence 1C11 [PD-1]_H3L3 as shown in FIG. 14.

In the mAb-ncIL-15/Rα format, one preferred embodiment utilizes the anti-PD-1 ABD having the sequence 1C11 [PD-1]_H3L3 as shown in FIG. 14 and the skew variant pair S364K/E357Q:L368D/K370S.

In the mAb-ncIL-15/Rα format, one preferred embodiment utilizes the anti-PD-1 ABD having the sequence 1C11 [PD-1]_H3L3 as shown in FIG. 14 in the FIG. 7 format.

In the mAb-ncIL-15/Rα format, one preferred embodiment utilizes the anti-PD-1 ABD having the sequence 1C11 [PD-1]_H3L3 as shown in FIG. 14 in the FIG. 7 format.

In the mAb-ncIL-15/Rα format, one preferred embodiment utilizes the anti-PD-1 ABD having an Fv sequence as depicted in FIG. 86.

I. mAb-dsIL-15/Rα

Figure 64I:
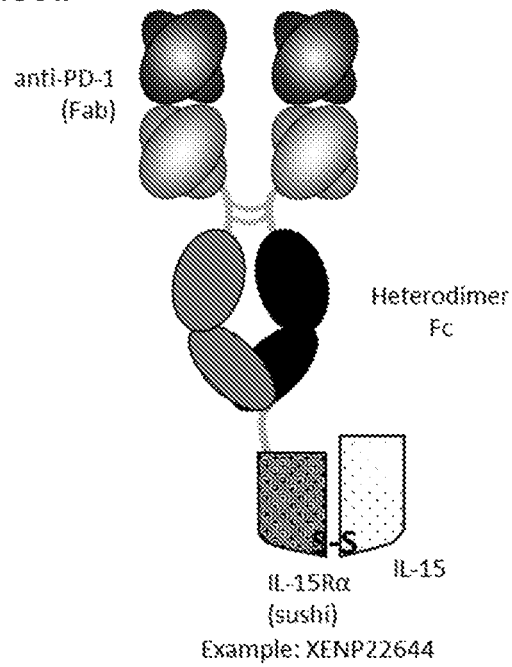

This embodiment is shown in FIG. 64I, and comprises four monomers (although the heterodimeric fusion protein is a pentamer). The first monomer comprises a heavy chain, VH-CH1-hinge-CH2-CH3. The second monomer comprises a heavy chain with an IL-15Rα(sushi) domain: VH-CH1-hinge-CH2-CH3-domain linker-sushi domain, where the sushi domain has been engineered to contain a cysteine residue. The third monomer is an IL-15 domain, which has been engineered to contain a cysteine residue, such that the IL-15 complex is formed under physiological conditions. The fourth (and fifth) monomer are light chains, VL-CL. This is generally referred to as "mAb-ncIL-15/Rα", with the "nc" standing for "non-covalent". Preferred combinations of variants for this embodiment are found in FIG. 7.

In the mAb-dsIL-15/Rα format, one preferred embodiment utilizes the anti-PD-1 ABD having the sequence 1G6_L1.194_H1.279 as shown in FIG. 14.

In the mAb-dsIL-15/Rα format, one preferred embodiment utilizes the skew variant pair S364K/E357Q:L368D/K370S.

In the mAb-dsIL-15/Rα format, one preferred embodiment utilizes the anti-PD-1 ABD having the sequence 1G6_L1.194_H1.279 as shown in FIG. 14, in the FIG. 7 format.

In the mAb-dsIL-15/Rα format, one preferred embodiment utilizes the anti-PD-1 ABD having the sequence 1G6_L1.194_H1.279 as shown in FIG. 14, in the FIG. 7 format.

In the mAb-ncIL-15/Rα format, one preferred embodiment utilizes the anti-PD-1 ABD having the sequence 1C11 [PD-1]_H3L3 as shown in FIG. 14.

In the mAb-dsIL-15/Rα format, one preferred embodiment utilizes the skew variant pair S364K/E357Q:L368D/K370S and utilizes the anti-PD-1 ABD having the sequence 1C11[PD-1]_H3L3 as shown in FIG. 14.

In the mAb-dsIL-15/Rα format, one preferred embodiment utilizes the anti-PD-1 ABD having the sequence 1C11 [PD-1]_H3L3 as shown in FIG. 14 in the FIG. 7 format.

In the mAb-dsIL-15/Rα format, one preferred embodiment utilizes the anti-PD-1 ABD having the sequence 1C11 [PD-1]_H3L3 as shown in FIG. 14 in the FIG. 7 format.

In the mAb-dsIL-15/Rα format, one preferred embodiment utilizes the anti-PD-1 ABD having an Fv sequence as depicted in FIG. 86.

J. Central-IL-15/Rα

Figure 64J:
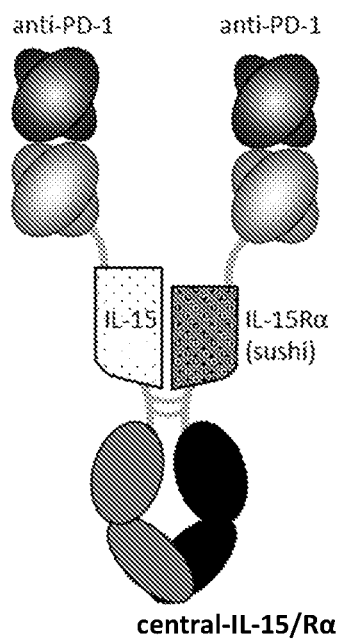

This embodiment is shown in FIG. 64J, and comprises four monomers forming a tetramer. The first monomer comprises a VH-CH1-[optional domain linker]-IL-15-[optional domain linker]-CH2-CH3, with the second optional domain linker sometimes being the hinge domain. The second monomer comprises a VH-CH1-[optional domain linker]-sushi domain-[optional domain linker]-CH2-CH3, with the second optional domain linker sometimes being the hinge domain. The third (and fourth) monomers are light chains, VL-CL. This is generally referred to as "Central-IL-15/Rα". Preferred combinations of variants for this embodiment are found in FIG. 7.

In the Central-IL-15/Rα format, one preferred embodiment utilizes the skew variant pair S364K/E357Q:L368D/K370S In the Central-IL-15/Rα format, one preferred embodiment utilizes the anti-PD-1 ABD having the sequence 1G6_L1.194_H1.279 as shown in FIG. 14.

In the Central-IL-15/Rα format, one preferred embodiment utilizes the anti-PD-1 ABD having the sequence 1G6_L1.194_H1.279 as shown in FIG. 14, in the FIG. 7 format.

In the Central-IL-15/Rα format, one preferred embodiment utilizes the anti-PD-1 ABD having the sequence 1G6_L1.194_H1.279 as shown in FIG. 14, in the FIG. 7 format.

In the Central-IL-15/Rα format, one preferred embodiment utilizes the anti-PD-1 ABD having the sequence 1C11 [PD-1]_H3L3 as shown in FIG. 14.

In the Central-IL-15/Rα format, one preferred embodiment utilizes the anti-PD-1 ABD having the sequence 1C11 [PD-1]_H3L3 as shown in FIG. 14 and the skew variant pair S364K/E357Q:L368D/K370S.

In the Central-IL-15/Rα format, one preferred embodiment utilizes the anti-PD-1 ABD having the sequence 1C11 [PD-1]_H3L3 as shown in FIG. 14 in the FIG. 7 format.

In the Central-IL-15/Rα format, one preferred embodiment utilizes the anti-PD-1 ABD having the sequence 1C11 [PD-1]_H3L3 as shown in FIG. 14 in the FIG. 7 format.

In the Central-IL-15/Rα format, one preferred embodiment utilizes the anti-PD-1 ABD having an Fv sequence as depicted in FIG. 86.

K. Central scIL-15/Rα

Figure 64K:
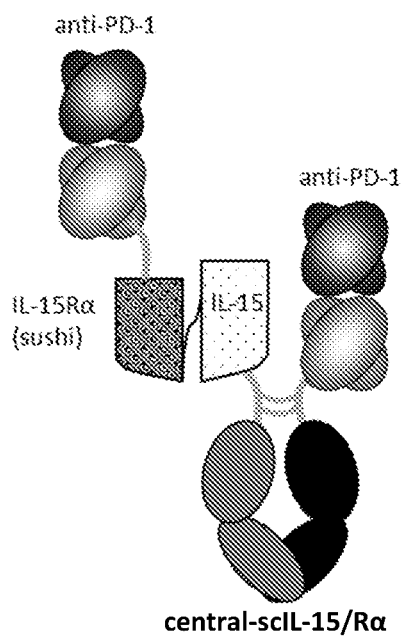

This embodiment is shown in FIG. 64K, and comprises four monomers forming a tetramer. The first monomer comprises a VH-CH1-[optional domain linker]-sushi domain-domain linker-IL-15-[optional domain linker]-CH2-CH3, with the second optional domain linker sometimes being the hinge domain. The second monomer comprises a VH-CH1-hinge-CH2-CH3. The third (and fourth) monomers are light chains, VL-CL. This is generally referred to as "Central-scIL-15/Rα", with the "sc" standing for "single chain". Preferred combinations of variants for this embodiment are found in FIG. 7.

In the Central-scIL-15/Rα format, one preferred embodiment utilizes the skew variant pair S364K/E357Q:L368D/K370S.

In the Central-scIL-15/Rα format, one preferred embodiment utilizes the anti-PD-1 ABD having the sequence 1G6_L1.194_H1.279 as shown in FIG. 14.

In the Central-scIL-15/Rα format, one preferred embodiment utilizes the anti-PD-1 ABD having the sequence 1G6_L1.194_H1.279 as shown in FIG. 14, in the FIG. 7 format.

In the Central-scIL-15/Rα format, one preferred embodiment utilizes the anti-PD-1 ABD having the sequence 1G6_L1.194_H1.279 as shown in FIG. 14, in the FIG. 7 format.

In the Central-scIL-15/Rα format, one preferred embodiment utilizes the anti-PD-1 ABD having the sequence 1C11 [PD-1]_H3L3 as shown in FIG. 14.

In the Central-scIL-15/Rα format, one preferred embodiment utilizes the anti-PD-1 ABD having the sequence 1C11 [PD-1]_H3L3 as shown in FIG. 14 and the skew variant pair S364K/E357Q:L368D/K370S.

In the Central-scIL-15/Rα format, one preferred embodiment utilizes the anti-PD-1 ABD having the sequence 1C11 [PD-1]_H3L3 as shown in FIG. 14 in the FIG. 7 format.

In the Central-scIL-15/Rα format, one preferred embodiment utilizes the anti-PD-1 ABD having the sequence 1C11 [PD-1]_H3L3 as shown in FIG. 14 in the FIG. 7 format.

In the Central-scIL-15/Rα format, one preferred embodiment utilizes the anti-PD-1 ABD having an Fv sequence as depicted in FIG. 86.

In the Central-scIL-15/Rα format, one preferred embodiment utilizes the scIL-15 complex sequence of FIG. 87A.

V. IL-15/IL-15Rα-Fc Fusion Monomers

The bispecific heterodimeric fusion proteins of the present invention include an IL-15/IL-15 receptor alpha (IL-15Rα)-Fc fusion monomer; reference is made to US Application entitled "IL15/IL15Rα HETERODIMERIC FC-FUSION PROTEINS", filed concurrently herewith on 16 Oct. 2017," and U.S. Ser. No. 62/408,655, filed on Oct. 14, 2016, U.S. Ser. No. 62/443,465, filed on Jan. 6, 2017, and U.S. Ser. No. 62/477,926, filed on Mar. 28, 2017, hereby incorporated by reference in their entirety and in particular for the sequences outlined therein. In some cases, the IL-15 and IL-15 receptor alpha (IL-15Rα) protein domains are in different orientations. Exemplary embodiments of IL-15/IL-15Rα-Fc fusion monomers are provided in XENP21480 (chain 1; FIG. 64A), XENP22022 (chain 1, FIG. 64D), XENP22112, (chains 1 and 3; FIG. 64E), XENP22641 (chains 2 and 4; FIG. 64F), XENP22642, (chains 1 and 4; FIG. 64H) and XENP22644 (chains 1 and 4; FIG. 64I).

In some embodiments, the human IL-15 protein has the amino acid sequence set forth in NCBI Ref. Seq. No. NP_000576.1 or SEQ ID NO:1. In some cases, the coding sequence of human IL-15 is set forth in NCBI Ref. Seq. No. NM_000585. An exemplary IL-15 protein of the Fc fusion heterodimeric protein outlined herein can have the amino acid sequence of SEQ ID NO:2 or amino acids 49-162 of SEQ ID NO:1. In some embodiments, the IL-15 protein has at least 90%, e.g., 90%, 91%, 92%, 93%, 94%, 95%, 96%, 97%, 98%, 99%, or more sequence identity to SEQ ID NO:2. In some embodiments, the IL-15 protein has the amino acid sequence set forth in SEQ ID NO:2 and the amino acid substitution N72D. In other embodiments, the IL-15 protein has the amino acid sequence of SEQ ID NO:2 and one or more amino acid substitutions selected from the group consisting of C42S, L45C, Q48C, V49C, L52C, E53C, E87C, and E89C. In some aspects, the IL15 protein has one or more amino acid substitutions selected from the group consisting of N1D, N4D, D8N, D30N, D61N, E64Q, N65D, and Q108E. In other embodiments, the amino acid substitutions are N4D/N65D. In some embodiments, the amino acid substitution is Q108E. In certain embodiments, the amino acid substitution is N65D. In other embodiments, the amino acid substitutions are D30N/E64Q/N65D. In certain embodiments, the amino acid substitution is N65D. In some instances, the amino acid substitutions are N1D/N65D. Optionally, the IL-15 protein also has an N72D substitution. The IL-15 protein of the Fc fusion protein can have 1, 2, 3, 4, 5, 6, 7, 8 or 9 amino acid substitutions.

In some embodiments, the human IL-15 receptor alpha (IL-15Rα) protein has the amino acid sequence set forth in NCBI Ref. Seq. No. NP_002180.1 or SEQ ID NO:3. In some cases, the coding sequence of human IL-15Rα is set forth in NCBI Ref. Seq. No. NM_002189.3. An exemplary the IL-15Rα protein of the Fc fusion heterodimeric protein outlined herein can comprise or consist of the sushi domain of SEQ ID NO:3 (e.g., amino acids 31-95 of SEQ ID NO:3), or in other words, the amino acid sequence of SEQ ID NO:4. In some embodiments, the IL-15Rα protein has the amino acid sequence of SEQ ID NO:4 and an amino acid insertion selected from the group consisting of D96, P97, A98, D96/P97, D96/C97, D96/P97/A98, D96/P97/C98, and D96/C97/A98, wherein the amino acid position is relative to full-length human IL-15Rα protein or SEQ ID NO:3. For instance, amino acid(s) such as D (e.g., Asp), P (e.g., Pro), A (e.g., Ala), DP (e.g., Asp-Pro), DC (e.g., Asp-Cys), DPA (e.g., Asp-Pro-Ala), DPC (e.g., Asp-Pro-Cys), or DCA (e.g., Asp-Cys-Ala) can be added to the C-terminus of the IL-15Rα protein of SEQ ID NO:4. In some embodiments, the IL-15Rα protein has the amino acid sequence of SEQ ID NO:4 and one or more amino acid substitutions selected from the group consisting of K34C, A37C, G38C, 540C, and L42C, wherein the amino acid position is relative to SEQ ID NO:4. The IL-15Rα protein can have 1, 2, 3, 4, 5, 6, 7, 8 or more amino acid mutations (e.g., substitutions, insertions and/or deletions).

In some embodiments, an IL-15 protein is attached to the N-terminus of an Fc domain, and an IL-15Rα protein is attached to the N-terminus of the IL-15 protein. In other embodiments, an IL-15Rα protein is attached to the N-terminus of an Fc domain and the IL-15Rα protein is non-covalently attached to an IL-15 protein. In yet other embodiments, an IL-15Rα protein is attached to the C-terminus of an Fc domain and the IL-15Rα protein is non-covalently attached to an IL-15 protein.

In some embodiments, the IL-15 protein and IL-15Rα protein are attached together via a linker ("scIL-15/Rα"). Optionally, the proteins are not attached via a linker, and utilize either native self-assembly or disulfide bonds as outlined herein. In other embodiments, the IL-15 protein and IL-15Rα protein are noncovalently attached. In some embodiments, the IL-15 protein is attached to an Fc domain via a linker. In other embodiments, the IL-15Rα protein is attached to an Fc domain via a linker. Optionally, a linker is not used to attach the IL-15 protein or IL-15Rα protein to the Fc domain.

In some instances, the PD-1 ABD is covalently attached to the N-terminus of an Fc domain via a linker, such as a domain linker.

In some embodiments, the linker is a "domain linker", used to link any two domains as outlined herein together. While any suitable linker can be used, many embodiments utilize a glycine-serine polymer, including for example (GS)n (SEQ ID NO: 7), (GSGGS)n (SEQ ID NO: 8), (GGGGS)n (SEQ ID NO: 9), and (GGGS)n (SEQ ID NO: 10), where n is an integer of at least 1 (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers can be used as discussed herein and shown in FIG. 4A-4B.

VI. PD-1 Antibody Monomers

Therapeutic antibodies directed against immune checkpoint inhibitors such as PD-1 are showing great promise in limited circumstances in the clinic for the treatment of cancer. Cancer can be considered as an inability of the patient to recognize and eliminate cancerous cells. In many instances, these transformed (e.g., cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells-especially T cells-to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy, Keytruda and Opdivo. These antibodies are generally referred to as "checkpoint inhibitors" because they block normally negative regulators of T cell immunity. It is generally understood that a variety of immunomodulatory signals, both costimulatory and coinhibitory, can be used to orchestrate an optimal antigen-specific immune response.

Generally, these monoclonal antibodies bind to checkpoint inhibitor proteins such as CTLA-4 and PD-1, which under normal circumstances prevent or suppress activation of cytotoxic T cells (CTLs). By inhibiting the checkpoint protein, for example through the use of antibodies that bind these proteins, an increased T cell response against tumors can be achieved. That is, these cancer checkpoint proteins suppress the immune response; when the proteins are blocked, for example using antibodies to the checkpoint protein, the immune system is activated, leading to immune stimulation, resulting in treatment of conditions such as cancer and infectious disease.

The present invention relates to the generation of bispecific heterodimeric proteins that bind to a PD-1 and cells expressing IL-2Rβ and the common gamma chain (γc; CD132). The bispecific heterodimeric protein can include an antibody monomer of any useful antibody format that can bind to an immune checkpoint antigen. In some embodiments, the antibody monomer includes a Fab or a scFv linked to an Fc domain. In some cases, the PD-1 antibody monomer contains an anti-PD1(VH)-CH1-Fc and an anti-PD-1 VL-Ckappa. In some cases, the PD-1 antibody monomer contains an anti-PD-1 scFv-Fc. Exemplary embodiments of such antibody fragments are provided in XENP21480 (chain 2; FIG. 64A), XENP22022 (chains 2 and 3; FIG. 64D), XENP22112 (chains 1 and 4; FIG. 64E), XENP22641 (chains 1 and 3; FIG. 64F), XENP22642 (chains 1-3; FIG. 64H), and XENP22644 (chains 1-3; FIG. 64I).

The ABD can be in a variety of formats, such as in a Fab format or in an scFv format. Exemplary ABDs for use in the present invention are disclosed in U.S. 62/353,511, the contents are hereby incorporated in its entirety for all purposes.

Suitable ABDs that bind PD-1 are shown in FIGS. 11 and 12 of U.S. 62/353,511, as well as those outlined in FIGS. 13 and 14 herein. As will be appreciated by those in the art, suitable ABDs can comprise a set of 6 CDRs as depicted in these Figures, either as they are underlined or, in the case where a different numbering scheme is used as described above, as the CDRs that are identified using other alignments within the vh and vl sequences of FIGS. 11 and 12 of U.S. 62/353,511. Suitable ABDs can also include the entire vh and vl sequences as depicted in these Figures, used as scFvs or as Fabs. Specific scFv sequences are shown in FIG. 11 U.S. 62/353,511, with a particular charged linker, although other linkers, such as those depicted in FIG. 7, can also be used. In many of the embodiments herein that contain an Fv to PD-1, it is the scFv monomer that binds PD-1. In U.S. 62/353,511, FIG. 11 shows preferred scFv sequences, and FIG. 12 depicts suitable Fab sequences, although as discussed herein, vh and vl of can be used in either configuration.

In addition, the antibodies of the invention include those that bind to either the same epitope as the antigen binding domains outlined herein, or compete for binding with the antigen binding domains outlined herein. In some embodiments, the bispecific checkpoint antibody can contain one of the ABDs outlined herein and a second ABD that competes for binding with one of the ABDs outlined herein. In some embodiments both ABDs compete for binding with the corresponding ABD outlined herein. Binding competition is generally determined using Biacore assays as outlined herein.

B. Antibodies

As is discussed below, the term "antibody" is used generally. Antibodies that find use in the present invention can take on a number of formats as described herein, including traditional antibodies as well as antibody derivatives, fragments and mimetics, described herein and depicted in the figures. The present invention provides antibody fusion proteins containing a checkpoint antigen binding domain and an Fc domain. In some embodiments, the antibody fusion protein forms a bispecific heterodimeric protein with an IL-15/IL-15Rα Fc fusion protein described herein. In other embodiments, the antibody fusion protein forms a bispecific heterodimeric protein with another antibody fusion protein comprising a checkpoint antigen binding domain and an Fc domain. Exemplary embodiments of such bispecific heterodimeric proteins include, but are not limited to, XENP21480, XENP22022, XENP22112, XENP22641, XENP22642, and XENP22644.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to antibodies or antibody fragments (antibody monomers) that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the sequences herein have at least one the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publ. Appl. No. 2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vhCDRs (e.g. vlCDR1, vlCDR2 and vlCDR3).

A useful comparison of CDR numbering is as below, see Lafranc et al., Dev. Comp. Immunol. 27(1):55-77 (2003):

TABLE 1

|  | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined above, is the Fc region.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the —CH2-CH3 domain, and optionally a hinge domain. In the embodiments herein, when a scFv is attached to an Fc domain, it is the C-terminus of the scFv construct that is attached to all or part of the hinge of the Fc domain; for example, it is generally attached to the sequence EPKS (SEQ ID NO: 15) which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, C-terminus of the variable light chain is attached to the N-terminus of the scFv linker, the C-terminus of which is attached to the N-terminus of a variable heavy chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIGS. 4A-4B of U.S. 62/353,511).

As shown herein, there are a number of suitable scFv linkers that can be used, including traditional peptide bonds, generated by recombinant techniques. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n (SEQ ID NO: 11), (GSGGS)n (SEQ ID NO: 12), (GGGGS)n (SEQ ID NO: 13), and (GGGS)n (SEQ ID NO: 14), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. While any suitable linker can be used, many embodiments utilize a glycine-serine polymer, including for example (GS)n (SEQ ID NO: 7), (GSGGS)n (SEQ ID NO: 8), (GGGGS)n (SEQ ID NO: 9), and (GGGS)n (SEQ ID NO: 10), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the scFv linker is a charged scFv linker, a number of which are shown in FIG. 4A of U.S. 62/353,511. Accordingly, the present invention further provides charged scFv linkers, to facilitate the separation in pI between a first and a second monomer (e.g., an IL-15/IL-15Rα monomer and PD-1 ABD monomer). That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 4A can be used in any embodiment herein where a linker is utilized.

In one embodiment, the antibody is an antibody fragment, as long as it contains at least one constant domain which can be engineered to produce heterodimers, such as pI engineering. Other antibody fragments that can be used include fragments that contain one or more of the CH1, CH2, CH3, hinge and CL domains of the invention that have been pI engineered. In particular, the formats depicted in FIGS. 8A-8C and 16A-16C are antibodies, referred to as "heterodimeric antibodies" or "bispecific heterodimer fusion proteins", meaning that the protein has at least two associated Fc sequences self-assembled into a heterodimeric Fc domain and at least one Fv regions, whether as Fabs or as scFvs.

C. Chimeric and Humanized Antibodies

In some embodiments, the antibodies herein can be derived from a mixture from different species, e.g., a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention). In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

VII. Useful Embodiments of the Invention

The present invention provides a bispecific heterodimeric protein comprising a fusion protein and an antibody fusion protein. The fusion protein comprises a first protein domain, a second protein domain, and a first Fc domain. In some cases, the first protein domain is covalently attached to the N-terminus of the second protein domain using a first domain linker, the second protein domain is covalently attached to the N-terminus of the first Fc domain using a second domain linker, and the first protein domain comprises an IL-15Rα protein and the second protein domain comprises an IL-15 protein. The antibody fusion protein comprises a PD-1 antigen binding domain and a second Fc domain such that the PD-1 antigen binding domain is covalently attached to the N-terminus of the second Fc domain, and the PD-1 antigen binding domain is a single chain variable fragment (scFv) or a Fab fragment. In some embodiments, the first and the second Fc domains have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some instances, the first and/or the second Fc domains have an additional set of amino acid substitutions comprising Q295E/N384D/Q418E/N421D, according to EU numbering. In some cases, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some embodiments, the IL-15 protein has a polypeptide sequence selected from the group consisting of SEQ ID NO:1 (full-length human IL-15) and SEQ ID NO:2 (truncated human IL-15), and the IL-15Rα protein has a polypeptide sequence selected from the group consisting of SEQ ID NO:3 (full-length human IL-15Rα) and SEQ ID NO:4 (sushi domain of human IL-15Rα). The IL-15 protein and the IL-15Rα protein can have a set of amino acid substitutions selected from the group consisting of E87C:D96/P97/C98; E87C:D96/C97/A98; V49C:S40C; L52C:S40C; E89C:K34C; Q48C:G38C; E53C:L42C; C42S:A37C; and L45C:A37C, respectively.

In some embodiments, said PD-1 antigen binding domain comprises an anti-PD-1 scFv or an anti-PD-1 Fab.

In some embodiments, the first fusion protein has a polypeptide sequence of SEQ ID NO: 233 (16478) and said Fab of the PD-1 antigen binding domain has polypeptide sequences of SEQ ID NO:XX (14833) and SEQ ID NO:XX (14812). In other embodiments, the bispecific heterodimeric protein can be XENP21480, XENP22022, or those depicted in FIGS. 8A, 8B, 13, and 14.

Also provided are nucleic acid compositions encoding the fusion protein or the antibody fusion protein described herein. In some instances, an expression vector comprising one or more nucleic acid compositions described herein. In some embodiments, a host cell comprising one or two expression vectors outlined herein is provided.

The present invention also provides a bispecific heterodimeric protein comprising a fusion protein, a second protein that is noncovalently attached to the first protein domain of the fusion protein, an antibody fusion protein. In some embodiments, the fusion protein comprises a first protein domain and a first Fc domain. The first protein domain can be covalently attached to the N-terminus of the first Fc domain using a domain linker and the first protein domain can include an IL-15Rα protein such as that of SEQ ID NO:3 or 4. In some instances, the second protein domain which is noncovalently attached to said first protein domain includes an IL-15 protein (SEQ ID NO:1) or a fragment of the IL-15 protein (SEQ ID NO:2). The IL-15 protein and the IL-15Rα protein can have a set of amino acid substitutions selected from the group consisting of E87C:D96/P97/C98; E87C:D96/C97/A98; V49C:S40C; L52C:S40C; E89C:K34C; Q48C:G38C; E53C:L42C; C42S:A37C; and L45C:A37C, respectively.

In some embodiments, the antibody fusion protein comprises an PD-1 antigen binding domain and a second Fc domain. In some instances, the PD-1 antigen binding domain is covalently attached to the N-terminus of the second Fc domain. The PD-1 antigen binding domain can be single chain variable fragment (scFv) or a Fab fragment. In some cases, the PD-1 antigen binding domain comprises an anti-PD-1 scFv or an anti-PD-1 Fab.

In some embodiments, the first and the second Fc domains of the bispecific heterodimeric proteins have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some instances, the first and/or the second Fc domains have an additional set of amino acid substitutions comprising Q295E/N384D/Q418E/N421D, according to EU numbering. In some cases, the first and/or the second Fc domains have an additional set of amino acid substitutions consisting of G236R/L328R, E233P/L234V/L235A/G236del/S239K, E233P/L234V/L235A/G236del/267K, E233P/L234V/L235A/G236del/S239K/A327G, E233P/L234V/L235A/G236del/S267K/A327G and E233P/L234V/L235A/G236del, according to EU numbering.

In certain embodiments, the bispecific heterodimeric protein comprises the fusion protein having a polypeptide sequence of SEQ ID NOS 230, 240, and 421 (16481), the second protein domain having a polypeptide sequence of SEQ ID NOS 238, 243, 256, and 265 (16484), and the Fab of the PD-1 antigen binding domain having polypeptide sequences of SEQ ID NO:XX (14833) and SEQ ID NO:XX (14812). In some embodiments, the bispecific heterodimer protein comprises the fusion protein having a polypeptide sequence of SEQ ID NO:XX (17584), the second protein domain having a polypeptide sequence of SEQ ID NOS 314, 319, 336, 340, and 348 (17074), and the Fab of the PD-1 antigen binding domain having polypeptide sequences of SEQ ID NO:XX (14833) and SEQ ID NO:XX (14812). In some instances, the bispecific heterodimer protein is selected from the group consisting of XENP22112, XENP22641, and those depicted in FIGS. 64A-64K.

Also provided are nucleic acid compositions encoding the fusion protein, the second protein domain, and/or the antibody fusion protein described herein. In some instances, an expression vector comprising one or two or three nucleic acid compositions described herein. In some embodiments, a host cell comprising one or two or three expression vectors outlined herein is provided.

The present invention also provides a bispecific heterodimeric protein comprising a first antibody fusion protein, a second antibody fusion protein, and a second protein domain that is noncovalently attached to the first protein domain of the second antibody fusion protein.

In some embodiments, the first antibody fusion protein comprises a first PD-1 antigen binding domain and a first Fc domain such that the first PD-1 antigen binding domain is covalently attached to the N-terminus of the first Fc domain via a first domain linker. The first PD-1 antigen binding domain can be a single chain variable fragment (scFv) or a Fab fragment.

In some embodiments, the second antibody fusion protein comprises a second PD-1 antigen binding domain, a second Fc domain, and a first protein domain such that the second PD-1 antigen binding domain is covalently attached to the N-terminus of said second Fc domain via a second domain linker. The first protein domain can be covalently attached to the C-terminus of the second Fc domain via a third domain linker. In some instance, the second PD-1 antigen binding domain is a single chain variable fragment (scFv) or a Fab fragment. The first protein domain can include an IL-15Rα protein, such as the protein set forth in SEQ ID NOS: 3 or 4.

In some embodiments, the second protein domain is noncovalently attached to the first proteindomain of the second antibody fusion protein and such second protein domain comprises an IL-15 protein, e.g., the protein set forth in SEQ ID NOS: 1 or 2.

The IL-15 protein and the IL-15Rα protein can have a set of amino acid substitutions selected from the group consisting of E87C:D96/P97/C98; E87C:D96/C97/A98; V49C:S40C; L52C:S40C; E89C:K34C; Q48C:G38C; E53C:L42C; C42S:A37C; and L45C:A37C, respectively.

In some embodiments, the first and the second Fc domains of the bispecific heterodimeric proteins have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some instances, the first and/or the second Fc domains have an additional set of amino acid substitutions comprising Q295E/N384D/Q418E/N421D, according to EU numbering. In some cases, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

The first PD-1 antigen binding domain of the first antibody fusion protein can include an anti-PD-1 scFv or an anti-PD-1 Fab. The second PD-1 antigen binding domain of the second antibody fusion protein can include an anti-PD-1 scFv or an anti-PD-1 Fab.

In some instances, the bispecific heterodimeric protein of the present invention contains a first antibody fusion protein having polypeptide sequences of SEQ ID NO:XX (17599) and SEQ ID NO: XX (9016), a second antibody fusion protein having polypeptide sequences of SEQ ID NO: 233 (16478) and SEQ ID NO: XX (9016), and a second protein domain having a polypeptide sequence of SEQ ID NOS 238, 243, 256, and 265 (16484). In other instances, the bispecific heterodimeric protein of the present invention contains a first antibody fusion protein having polypeptide sequences of SEQ ID NO:XX (17601) and SEQ ID NO: XX (9016), a second antibody fusion protein having polypeptide sequences of SEQ ID NO:XX (9018) and SEQ ID NO: XX (9016), and a second protein domain having a polypeptide sequence of SEQ ID NOS 314, 319, 336, 340, and 348 (17074). The bispecific heterodimeric protein can be XENP22642 or XENP22644 or those depicts in FIGS. 16B, 16C, 18 and 19.

VIII. Nucleic Acids of the Invention

The invention further provides nucleic acid compositions encoding the bispecific heterodimeric fusion protein of the invention (or, in the case of a monomer Fc domain protein, nucleic acids encoding those as well).

As will be appreciated by those in the art, the nucleic acid compositions will depend on the format of the bispecific heterodimeric fusion protein. Thus, for example, when the format requires three amino acid sequences, three nucleic acid sequences can be incorporated into one or more expression vectors for expression. Similarly, some formats only two nucleic acids are needed; again, they can be put into one or two expression vectors.

As is known in the art, the nucleic acids encoding the components of the invention can be incorporated into expression vectors as is known in the art, and depending on the host cells used to produce the bispecific heterodimeric fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids are contained on a different expression vector.

The bispecific heterodimeric fusion protein of the invention are made by culturing host cells comprising the expression vector(s) as is well known in the art. Once produced, traditional fusion protein or antibody purification steps are done, including an ion exchange chromotography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the heterodimer (e.g., anionic exchange columns, cationic exchange columns). These substitutions also aid in the determination and monitoring of any contaminating homodimers post-purification (e.g., IEF gels, cIEF, and analytical IEX columns).

IX. Biological and Biochemical Functionality of Bispecific Immune Checkpoint Antibody×IL-15/IL-15Rα Heterodimeric Immunomodulatory Fusion Proteins Generally the bispecific heterodimeric fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on CD4$^+$ T cell activation or proliferation, CD8$^+$ T (CTL) cell activation or proliferation, CD8$^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or dephosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFNγ, TNF-a, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Similarly, increases of at least one-, two-, three-, four- or five-fold as compared to reference or control samples show efficacy.

X. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the bispecific heterodimeric compositions of the invention find use in the treatment of these cancers.

A. Bispecific Heterodimeric Protein Compositions for In Vivo Administration

Formulations of the antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol; low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

B. Administrative Modalities

The bispecific heterodimeric proteins and chemotherapeutic agents of the invention are administered to a subject, in accord with known methods, such as intravenous administration as a bolus or by continuous infusion over a period of time.

C. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

An exemplary, non-limiting range for a therapeutically effective amount of an bispecific antibody used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein. Examples 1 and 2 from U.S. Ser. No. 62,416, 087, filed on Nov. 1, 2016 are expressly incorporated by reference in their entirety, including the corresponding figures.

XI. Example 1: Anti-PD-1 ABDs

A. 1A: Illustrative Anti-PD-1 ABDs

Examples of antibodies which bind PD-1 were generated in bivalent IgG1 format with E233P/L234V/L235A/G236del/S267K substitutions, illustrative sequences for which are depicted in FIGS. 13A-13E. DNA encoding the variable regions was generated by gene synthesis and was inserted into the mammalian expression vector pTT5 by the Gibson Assembly method. Heavy chain VH genes were inserted via Gibson Assembly into pTT5 encoding the human IgG1 constant region with the substitutions mentioned above. Light chains VL genes were inserted into pTT5 encoding the human Cκ constant region. DNA was transfected into HEK293E cells for expression. Additional PD-1 ABDs (including those derived from the above antibodies) were formatted as Fabs and scFvs for use in IL-15/Rα×anti-PD-1 bifunctional proteins of the invention, illustrative sequences for which are depicted respectively in FIGS. 14A-14E and in the sequence listing.

B. 1B: Generation of Anti-PD-1 Clone 1C11

1. 1B(a): Generation and Screening of Anti-PD-1 Hybridoma

To develop additional PD-1 targeting arms for IL-15/Rα× anti-PD-1 bifunctional proteins of the invention, monoclonal antibodies were first generated by hybridoma technology through ImmunoPrecise, through their Standard Method and Rapid Prime Method. For the Standard Method, antigen(s) was injected into 3 BALB/c mice. 7-10 days before being sacrificed for hybridoma generation, the immunized mice received an antigen boost. Antibody titre is evaluated by ELISA on the antigen and the best responding mice are chosen for fusion. A final antigen boost is given 4 days prior to fusion. Lymphocytes from the mice are pooled, purified then fused with SP2/0 myeloma cells. Fused cells are grown on HAT selective Single-Step cloning media for 10-12 days at which point the hybridomas were ready for screening. For the Rapid Prime method, antigen(s) was injected into 3 BALB/c mice. After 19 days, lymphocytes from all the mice are pooled, purified then fused with SP2/0 myeloma cells. Fused cells are grown on HAT selective Single-Step cloning media for 10-12 days at which point the hybridomas were ready for screening. Antigen(s) used were mouse Fc fusion of human PD-1 (huPD-1-mFc), mouse Fc fusion of cyno PD-1 (cynoPD-1-mFc), His-tagged human PD-1 (huPD-1-His), His-tagged cyno PD-1 (cynoPD-1-His) or mixtures thereof.

Anti-PD-1 hybridoma clones generated as described above were subject to two rounds of screening using Octet, a BioLayer Interferometry (BLI)-based method. Experimental steps for Octet generally included the following: Immobilization (capture of ligand or test article onto a biosensor); Association (dipping of ligand- or test article-coated biosensors into wells containing serial dilutions of the corresponding test article or ligand); and Dissociation (returning of biosensors to well containing buffer) in order to determine the affinity of the test articles. A reference well containing buffer alone was also included in the method for background correction during data processing.

For the first round, anti-mouse Fc (AMC) biosensors were used to capture the clones with dips into 500 nM of bivalent human and cyno PD-1-Fc-His. For the second round, clones identified in the first round that were positive for both human and cyno PD-1 were captured onto AMC biosensors and dipped into 500 nM monovalent human and cyno PD-1-His.

2. 1B(b): Characterization of Clone 1C11

One hybridoma clone identified in Example 1B(a) was clone 1C11. DNA encoding the VH and VL of hybridoma clone 1C11 were generated by gene synthesis and subcloned using standard molecular biology techniques into expression vector pTT5 containing human IgG1 constant region with E233P/L234V/L235A/G236del/S267K substitutions to generate XENP21575, sequences for which are depicted in FIG. 15.

a. 1B(b)(i): PD-L1 Blocking with Clone 1C11

Blocking of checkpoint receptor/ligand interaction is necessary for T cell activation. The blocking ability of XENP21575 was investigated in a cell binding assay. HEK293T cells transfected to express PD-1 were incubated with XENP21575, as well as control antibodies. Following incubation, a murine Fc fusion of PD-L1 was added and allowed to incubate. Binding of PD-L1-mFc to HEK293T cells was detected with an anti-murine IgG secondary antibody, data for which are depicted in FIG. 16.

b. 1B(b)(ii): T Cell Surface Binding of Clone 1C11

Binding of anti-PD-1 clone 1C11 to T cells was measured in an SEB-stimulated PBMC assay. Staphylococcal Enterotoxin B (SEB) is a superantigen that causes T cell activation and proliferation in a manner similar to that achieved by activation via the T cell receptor (TCR), including expression of checkpoint receptors such as PD-1. Human PBMCs were stimulated with 100 ng/mL for 3 days. Following stimulation, PBMCs were incubated with the indicated test articles at indicated concentrations at 4° C. for 30 min. PBMCs were stained with anti-CD3-FITC (UCHT1) and APC labeled antibody for human immunoglobulin κ light chain. The binding of the test articles to T cells as indicated by APC MFI on FITC+ cells is depicted in FIG. 17.

c. 1B(b)(iii): T Cell Activation by Clone 1C11

T cell activation by clone 1C11, as indicated by cytokine secretion, was investigated in an SEB-stimulated PBMC assay. Human PBMCs were stimulated with 500 ng/mL SEB for 2 days. Cells were then washed twice in culture medium and stimulated with 500 ng/mL SEB in combination with indicated amounts of indicated test articles for 24 hours. Supernatants were then assayed for IL-2 and IFNγ by cells, data for which are depicted in FIG. 18.

3. 1B(c): Humanization of Clone 1C11

Clone 1C11 humanized using string content optimization (see, e.g., U.S. Pat. No. 7,657,380, issued Feb. 2, 2010). DNA encoding the heavy and light chains were generated by gene synthesis and subcloned using standard molecular biology techniques into the expression vector pTT5. Sequences for an illustrative humanized variant of clone 1C11 in bivalent antibody format are depicted in depicted in FIG. 19. Sequences for additional humanized variants of clone 1C11 are listed as XENPs 22543, 22544, 22545, 22546, 22547, 22548, 22549, 22550, 22551, 22552, and 22554 in the figures and the sequence listing.

The affinity of XENP22553 was determined using Octet as generally described in Example 1B(a). In particular, anti-human Fc (AHC) biosensors were used to capture the test article with dips into multiple concentrations of histidine-tagged PD-1. The affinity result and corresponding sensorgram are depicted in FIG. 20.

XII. Example 2: IL-15/Rα-Fc

A. 2A: Engineering IL-15 Rα-Fc Fusion Proteins

In order to address the short half-life of IL-15/IL-15Rα heterodimers, we generated the IL-15/IL-15Rα(sushi) complex as a Fc fusion (hereon referred to as IL-15/Rα-Fc fusion proteins) with the goal of facilitating production and promoting FcRn-mediated recycling of the complex and prolonging half-life.

Plasmids coding for IL-15 or IL-15Rα sushi domain were constructed by standard gene synthesis, followed by sub-cloning into a pTT5 expression vector containing Fc fusion partners (e.g., constant regions as depicted in FIG. 10A-10D). Cartoon schematics of illustrative IL-15/Rα-Fc fusion protein formats are depicted in FIGS. 21A-21G.

Illustrative proteins of the IL-15/Rα-heteroFc format (FIG. 21A) include XENP20818 and XENP21475, sequences for which are depicted in FIG. 22, with sequences for additional proteins of this format are XENPs 20819, 21471, 21472, 21473, 21474, 21476, 21477 depicted in the figures. An illustrative proteins of the scIL-15/Rα-Fc format (FIG. 21B) is XENP21478, sequences for which are depicted in FIG. 23, with sequences for additional proteins of this format depicted as XENPs 21993, 21994, 21995, 23174, 23175, 24477, 24480 in the figures. Illustrative proteins of the ncIL-15/Rα-Fc format (FIG. 21C) include XENP21479, XENP22366, and XENP24348 sequences for which are depicted in FIG. 24. An illustrative protein of the bivalent ncIL-15/Rα-Fc format (FIG. 21D) is XENP21978, sequences for which are depicted in FIG. 25, with sequences for additional proteins of this format depicted as XENP21979. Sequences for an illustrative protein of the bivalent scIL-15/Rα-Fc format (FIG. 21E) are depicted in FIG. 26. An illustrative protein of the Fc-ncIL-15/Rα format (FIG. 21F) is XENP22637, sequences for which are depicted in FIG. 27, with sequences for additional proteins of this format are depicted as XENP22638 in the figures. Sequences for an illustrative protein of the Fc-scIL-15/Rα format (FIG. 21G) are depicted in FIG. 28.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

IL-15/Rα-Fc fusion proteins in the various formats as described above were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cy5.5 (OKT4), anti-CD27-PE (M-T271), anti-CD56-BV421 (5.1H11), anti-CD16-BV421 (3G8), and anti-CD45RA-BV605 (Hi100) to gate for the following cell types: CD4+ T cells, CD8+ T cells, and NK cells (CD56+/CD16+). Ki67 is a protein strictly associated with cell proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIGS. 29A-29C and FIGS. 30A-30C). The various IL-15/Rα-Fc fusion proteins induced strong proliferation of CD8+ T cells and NK cells. Notably, differences in proliferative activity were dependent on the linker length on the IL-15-Fc side. In particular, constructs having no linker (hinge only), including XENP21471, XENP21474, and XENP21475, demonstrated weaker proliferative activity.

B. 2B: IL-15/Rα-Fc Fusion Proteins with Engineered Disulfide Bonds

To further improve stability and prolong the half-life of IL-15/Rα-Fc fusion proteins, we engineered disulfide bonds into the IL-15/Rα interface. By examining the crystal structure of the IL-15/Rα complex, as well as by modeling using Molecular Operating Environment (MOE; Chemical Computing Group, Montreal, Quebec, Canada) software, we predicted residues at the IL-15/Rα interface that may be substituted with cysteine in order to form covalent disulfide bonds, as depicted in FIG. 31. Additionally, up to three amino acids following the sushi domain in IL-15Rα were added to the C-terminus of IL-15Rα(sushi) as a scaffold for engineering cysteines (illustrative sequences for which are depicted in FIG. 32). Sequences for illustrative IL-15 and IL-15Rα(sushi) variants engineered with cysteines are respectively depicted in FIGS. 33 and 34

Plasmids coding for IL-15 or IL-15Rα(sushi) were constructed by standard gene synthesis, followed by subcloning into a pTT5 expression vector containing Fc fusion partners (e.g., constant regions as depicted in FIGS. 10A-10D. Residues identified as described above were substituted with cysteines by standard mutagenesis techniques. Cartoon schematics of IL-15/Rα-Fc fusion proteins with engineered disulfide bonds are depicted in FIGS. 35A-35D.

Illustrative proteins of the dsIL-15/Rα-heteroFc format (FIG. 35A) include XENP22013, XENP22014, XENP22015, and XENP22017, sequences for which are depicted in FIG. 36. Illustrative proteins of the dsIL-15/Rα-Fc format (FIG. 35B) include XENP22357, XENP22358, XENP22359, XENP22684, and XENP22361, sequences for which are depicted in FIG. 37, with sequences for additional proteins of this format depicted as XENPs 22360, 22362, 22363, 22364, 22365, 22366 in the figures. Illustrative protein of the bivalent dsIL-15/Rα-Fc format (FIG. 35C) include XENP22634, XENP22635, and XENP22636, sequences for which are depicted in FIG. 38, with sequences for additional proteins of this format depicted as XENP22687 in the figures. Illustrative proteins of the Fc-dsIL-15/Rα format (FIG. 35D) include XENP22639 and XENP22640, sequences for which are depicted in FIG. 39.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

After the proteins were purified, they were characterized by capillary isoelectric focusing (CEF) for purity and homogeneity. CEF was performed using LabChip GXII Touch HT (PerkinElmer, Waltham, Mass.) using Protein Express Assay LabChip and Protein Express Assay Reagent Kit carried out using the manufacturer's instructions. Samples were run in duplicate, one under reducing (with dithiothreitol) and the other under non-reducing conditions. Many of the disulfide bonds were correctly formed as indicated by denaturing non-reducing CEF, where the larger molecular weight of the covalent complex can be seen when compared to the controls without engineered disulfide bonds (FIG. 40).

The proteins were then tested in a cell proliferation assay. IL-15/Rα-Fc fusion proteins (with or without engineered disulfide bonds) or controls were incubated with PBMCs for 4 days. Following incubation, PBMCs were stained with anti-CD4-PerCP/Cy5.5 (RPA-T4), anti-CD8-FITC (RPA-T8), anti-CD45RA-BV510 (HI100), anti-CD16-BV421 (3G8), anti-CD56-BV421 (HCD56), anti-CD27-PE (0323), and anti-Ki67-APC (Ki-67) to mark various cell populations and analyzed by FACS as generally described in Example 2A. Proliferation of NK cells, CD4+ T cells, and CD8+ T cells as indicated by Ki67 expression are depicted in FIGS. 41A-41C. Each of the IL-15/Rα-Fc fusion proteins and the IL-15 control induced strong proliferation of NK cells, CD8+ T cells, and CD4+ T cells.

C. 2C:IL-15/Rα-Fc Fusion Proteins Engineered for Lower Potency and Increased PK and Half-Life In order to further improve PK and prolong half-life, we reasoned that decreasing the potency of IL-15 would decrease the antigen sink, and thus, increase the half-life. By examining the crystal structure of the IL-15:IL-2Rβ and IL-15:common gamma chain interfaces, as well as by modeling using MOE software, we predicted residues at these interfaces that may be substituted in order to reduce potency. FIG. 42 depicts a structural model of the IL-15:receptor complexes showing locations of the predicted residues where we engineered isosteric substitutions (in order to reduce the risk of immunogenicity). Sequences for illustrative IL-15 variants engineered for reduced potency are depicted in FIG. 43.

Plasmids coding for IL-15 or IL-15Rα(sushi) were constructed by standard gene synthesis, followed by subcloning into a pTT5 expression vector containing Fc fusion partners (e.g., constant regions as depicted in FIG. 10a-10D). Substitutions identified as described above were incorporated by standard mutagenesis techniques. Sequences for illustrative IL-15/Rα-Fc fusion proteins of the "IL-15/Rα-heteroFc" format engineered for reduced potency are depicted in FIG. 44, with additional sequences depicted as XENPs 22815, 22816, 22817, 22818, 22819, 22820, 22823, 22824, 22825, 22826, 22827, 22828, 22829, 22830, 22831, 22832, 22833, 22834, 23555, 23559, 23560, 24017, 24020, and 24043, and 24048 in the figures and the sequence listing. Sequences for illustrative IL-15/Rα-Fc fusion proteins of the "scIL-15/Rα-Fc" format engineered for reduced potency are depicted in FIG. 45, with additional sequences depicted as XENPs 24013, 24014, and 24016 in the figures. Sequences for illustrative IL-15/Rα-Fc fusion proteins of the "ncIL-15/Rα-Fc" format engineered for reduced potency are depicted in FIG. 46. Sequences for illustrative ncIL-15/Rα heterodimers engineered for reduced potency are depicted in FIG. 47, with additional sequences depicted as XENPs 22791, 22792, 22793, 22794, 22795, 22796, 22803, 22804, 22805, 22806, 22807, 22808, 22809, 22810, 22811, 22812, 22813, and 22814 in the figures. Sequences for an illustrative IL-15/Rα-Fc fusion protein of the "bivalent ncIL-15/Rα-Fc" format engineered for reduced potency are depicted in FIG. 48. Sequences for illustrative IL-15/Rα-Fc fusion proteins of the "dsIL-15/Rα-Fc" format engineered for reduced potency are depicted in FIG. 49. Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

1. 2C(a): In Vitro Activity of Variant IL-15/Rα-Fc Fusion Proteins Engineered for Decreased Potency The variant IL-15/Rα-Fc fusion proteins were tested in a number of cell proliferation assays.

In a first cell proliferation assay, IL-15/Rα-Fc fusion proteins (with or without engineered substitutions) or control were incubated with PBMCs for 4 days. Following incubation, PBMCs were stained with anti-CD4-Evolve605 (SK-3), anti-CD8-PerCP/Cy5.5 (RPA-T8), anti-CD45RA-APC/Cy7 (HI100), anti-CD16-eFluor450 (CB16), anti-CD56-eFluor450 (TULY56), anti-CD3-FITC (OKT3), and anti-Ki67-APC (Ki-67) to mark various cell populations and analyzed by FACS as generally described in Example 2A. Proliferation of NK cells, CD8+ T cells, and CD4+ T cells as indicated by Ki67 expression are depicted in FIGS. 50A-50C and 51. Most of the IL-15/Rα-Fc fusion proteins induced proliferation of each cell population; however, activity varied depending on the particular engineered substitutions.

In a second cell proliferation assay, IL-15/Rα-Fc fusion proteins (with or without engineered substitutions) were incubated with PBMCs for 3 days. Following incubation, PBMCs were stained with anti-CD3-FITC (OKT3), anti-CD4-Evolve604 (SK-3), anti-CD8-PerCP/Cy5.5 (RPA-T8), anti-CD16-eFluor450 (CB16), anti-CD56-eFluor450 (TULY56), anti-CD27-PE (0323), anti-CD45RA-APC/Cy7 (HI100) and anti-Ki67-APC (20Raj1) antibodies to mark various cell populations. FIGS. 52A-52C and 53A-53C depict selection of various cell populations following incubation with XENP22821 by FACS. Lymphocytes were first gated on the basis of side scatter (SSC) and forward scatter (FSC) (FIG. 52A). Lymphocytes were then gated based on CD3 expression (FIG. 52B). Cells negative for CD3 expression were further gated based on CD16 expression to identify NK cells (CD16+) (FIG. 52C). CD3+ T cells were further gated based on CD4 and CD8 expression to identify CD4+ T cells, CD8+ T cells, and γδ T cells (CD3+CD4−CD8−) (FIG. 53A). The CD4+ and CD8+ T cells were gated for CD45RA expression as shown respectively in FIGS. 53B-53C. Finally, the proliferation of the various cell populations were determined based on percentage Ki67 expression, and the data are shown in FIGS. 55A-55D. NK and CD8+ T cells are more sensitive than CD4+ T cells to IL-15/Rα-Fc fusion proteins, and as above, proliferative activity varied depending on the particular engineered substitutions. FIG. 55D shows the fold change in EC50 of various IL-15/Rα-Fc fusion proteins relative to control XENP20818. FIGS. 54A and 54B further depict the activation of lymphocytes following treatment with IL-15/Rα-Fc fusion proteins by gating for the expression of CD69 and CD25 (T cell activation markers) before and after incubation of PBMCs with XENP22821.

In a third experiment, additional variant IL-15/Rα-Fc fusion proteins were incubated with human PBMCs for 3 days at 37° C. Following incubation, PBMCs were stained with anti-CD3-FITC (OKT3), anti-CD4-SB600 (SK-3), anti-CD8-PerCP/Cy5.5 (RPA-T8), anti-CD45RA-APC/Cy7 (HI100), anti-CD16-eFluor450 (CB16), anti-CD25-PE (M-A251), and anti-Ki67-APC (Ki-67) to mark various cell populations and analyzed by FACS as generally described in Example 2A. Proliferation of CD8+ (CD45RA−) T cells, CD4+ (CD45RA−) T cells, γδ T cells, and NK cells as indicated by Ki67 expression are depicted in FIGS. 56A-D.

In a fourth experiment, human PBMCs were incubated with the additional IL-15/Rα-Fc variants at the indicated concentrations for 3 days. Following incubation, PBMCs were stained with anti-CD3-FITC (OKT3), anti-CD4 (SB600), anti-CD8-PerCP/Cy5.5 (RPA-T8), anti-CD16-eFluor450 (CB16), anti-CD25-PE (M-A251), anti-CD45RA-APC/Cy7 (HI100), and anti-Ki67-APC (Ki67) and analyzed by FACS as generally described in Example 2A. Percentage of Ki67 on CD8+ T cells, CD4+ T cells and NK cells following treatment are depicted in FIG. 57.

In a fifth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SKI), anti-CD8β-APC (2ST8.5H7), anti-CD16-BV421 (3G8), anti-CD25-PerCP/Cy5.5 (M-A251), anti-CD45RA-APC/Cy7 (HI100), anti-CD56-BV605 (NCAM16.2), and anti-Ki67-PE/Cy7 (Ki-67) and analyzed by FACS as generally described in Example 2A. Percentage of Ki67 on CD8+ T cells, CD4+ T cells, γδ T cells, and NK cells are depicted in FIGS. 58A-58E.

In a sixth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SKI), anti-CD8β-APC (SIDI8BEE), anti-CD16-BV421 (3G8), anti-CD25-PerCP/Cy5.5 (M-A251), anti-CD45RA-APC/Cy7 (HI100), anti-CD56-BV605 (NCAM16.2), and anti-Ki67-PE/Cy7 (Ki-67) and analyzed by FACS as generally described in Example 2A. Percentage of Ki67 on CD8+ T cells, CD4+ T cells, γδ T cells, and NK cells are depicted in FIGS. 59A-59E.

In a seventh experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cy5.5 (M-A251), anti-CD45RA-APC/Fire750 (HI100) and anti-Ki67-PE/Cy7 (Ki-67) and analyzed by FACS as generally described in Example 2A. Percentage Ki67 on CD8+ T cells, CD4+ T cells, γδ T cells and NK (CD16+) cells are depicted in FIGS. 60A-60D. The data show that the ncIL-15/Rα-Fc fusion protein XENP21479 is the most potent inducer of CD8+ T cell, CD4+ T cell, NK (CD16+) cell, and γδ T cell proliferation. Each of the scIL-15/Rα-Fc fusion proteins were less potent than XENP21479 in inducing proliferation, but differences were dependent on both the linker length, as well as the particular engineered substitutions.

In an eighth experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cy5.5 (M-A251), anti-CD45RA-APC/Fire750 (HI100) and anti-Ki67-PE/Cy7 (Ki-67) and analyzed by FACS as generally described in Example 2A. Percentage Ki67 on CD8+ T cells, CD4+ T cells, γδ T cells and NK (CD16+) cells are respectively depicted in FIGS. 61A-61D. As above, the data show that the ncIL-15/Rα-Fc fusion protein XENP21479 is the most potent inducer of CD8+ T cell, CD4+ T cell, NK (CD16+) cell, and γδ T cell proliferation. Notably, introduction of Q108E substitution into the ncIL-15/Rα-Fc format (XENP24349) drastically reduces its proliferative activity in comparison to wildtype (XENP21479).

2. 2C(b): PK of IL-15/Rα-Fc Fusion Proteins Engineered for Reduced Potency

In order to investigate if IL-15/Rα-Fc fusion proteins engineered for reduced potency had improved half-life and PK, we examined these variants in a PK study in C57BL/6 mice. Two cohorts of mice (5 mice per test article per cohort) were dosed with 0.1 mg/kg of the indicated test articles via IV-TV on Day 0. Serum was collected 60 minutes after dosing and then on Days 2, 4, and 7 for Cohort 1 and Days 1, 3, and 8 for Cohort 2. Serum levels of IL-15/Rα-Fc fusion proteins were determined using anti-IL-15 and anti-IL-15Rα antibodies in a sandwich ELISA. The results are depicted in FIG. 62. FIG. 63 depicts the correlation between potency and half-life of the test articles. As predicted, variants with reduced potency demonstrated substantially longer half-life. Notably, half-life was improved up to almost 9 days (see XENP22821 and XENP22822), as compared to 0.5 days for the wild-type control XENP20818.

XIII. Example 3: IL-15/Rα×Anti-PD-1 Bifunctionals

A. 3A: Generation and Physical Characterization of IL-15/Rα×Anti-PD-1 Bifunctionals Plasmids coding for IL-15, IL-15Rα sushi domain, or the anti-PD-1 variable regions were constructed by standard gene synthesis, followed by subcloning into a pTT5 expression vector containing Fc fusion partners (e.g., constant regions as depicted in FIG. 11. Cartoon schematics of illustrative IL-15/Rα×anti-PD-1 bifunctionals are depicted in FIG. 64.

The "scIL-15/Rα×scFv" format (FIG. 64A) comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc. Sequences for illustrative bifunctional proteins of this format are depicted in FIG. 65.

The "scFv×ncIL-15/Rα" format (FIG. 64B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed. Sequences for illustrative bifunctional proteins of this format are depicted in FIG. 66.

The "scFv×dsIL-15/Rα" format (FIG. 64C) is the same as the "scFv×ncIL-15/Rα" format, but wherein IL-15Rα(sushi) and IL-15 are covalently linked as a result of engineered cysteines. Sequences for illustrative bifunctional proteins of this format are depicted in FIG. 67.

The "scIL-15/Rα×Fab" format (FIG. 64D) comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. Sequences for illustrative bifunctional proteins of this format are depicted in FIG. 68.

The "ncIL-15/Rα×Fab" format (FIG. 64E) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. Sequences for illustrative bifunctional proteins of this format are depicted in FIG. 69.

The "dsIL-15/Rα×Fab" format (FIG. 64F) is the same as the "ncIL-15/Rα×Fab" format, but wherein IL-15Rα(sushi) and IL-15 are covalently linked as a result of engineered cysteines. Sequences for illustrative bifunctional proteins of this format are depicted in FIG. 70.

The "mAb-scIL-15/Rα" format (FIG. 64G) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs. Sequences for illustrative bifunctional proteins of this format are depicted in FIG. 71.

The "mAb-ncIL-15/Rα" format (FIG. 64H) comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed. Sequences for illustrative bifunctional proteins of this format are depicted in FIG. 72.

The "mAb-dsIL-15/Rα" format (FIG. 64I) is the same as the "mAb-ncIL-15/Rα" format, but wherein IL-15Rα(sushi) and IL-15 are covalently linked as a result of engineered cysteines. Sequences for illustrative bifunctional proteins of this format are depicted in FIG. 73.

The "central-IL-15/Rα" format (FIG. 64J) comprises a VH recombinantly fused to the N-terminus of IL-15 which is then further fused to one side of a heterodimeric Fc and a VH recombinantly fused to the N-terminus of IL-15Rα (sushi) which is then further fused to the other side of the heterodimeric Fc, while corresponding light chains are transfected separately so as to form a Fabs with the VHs. Sequences for illustrative bifunctional proteins of this format are depicted in FIG. 74.

The "central-scIL-15/Rα" format (FIG. 64K) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs. Sequences for illustrative bifunctional proteins of this format are depicted in FIG. 75.

IL-15/Rα×anti-PD-1 bifunctional proteins were characterized by size-exclusion chromatography (SEC) and capillary isoelectric focusing (CEF) for purity and homogeneity.

Figure 76A:
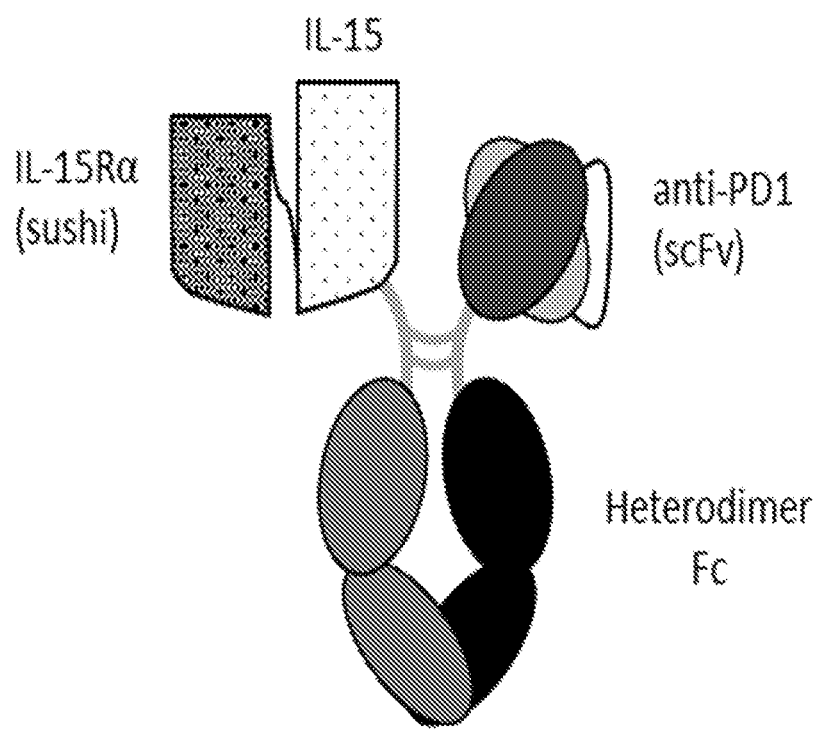
Figure 76B:
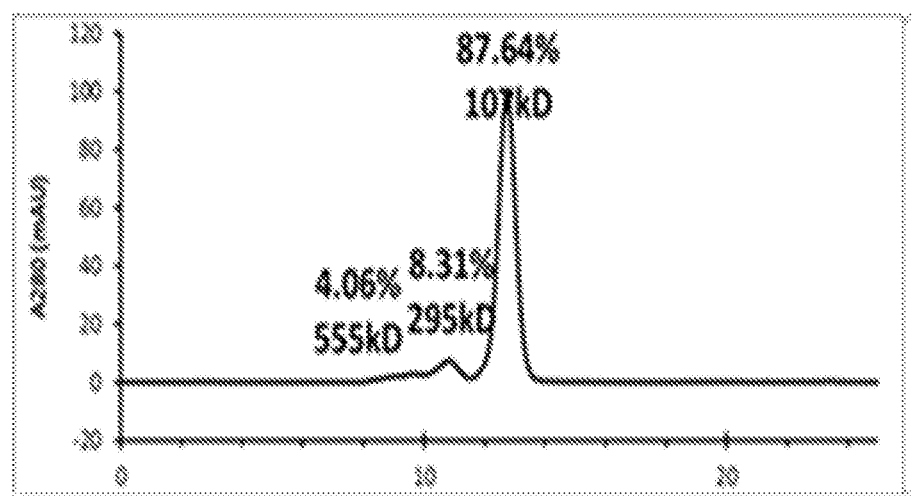

The proteins were analyzed using SEC to measure their size (i.e. hydrodynamic volume) and determine the native-like behavior of the purified samples. The analysis was performed on an Agilent 1200 high-performance liquid chromatography (HPLC) system. Samples were injected onto a Superdex™ 200 10/300 GL column (GE Healthcare Life Sciences) at 1.0 mL/min using 1×PBS, pH 7.4 as the mobile phase at 4° C. for 25 minutes with UV detection wavelength at 280 nM. Analysis was performed using Agilent OpenLab Chromatography Data System (CDS) ChemStation Edition AIC version C.01.07. Chromatogram for an illustrative IL-15/Rα×anti-PD-1 bifunctional XENP21480 in the IL-15/Rα×scFv format is shown in FIG. 76B.

Figure 76C:
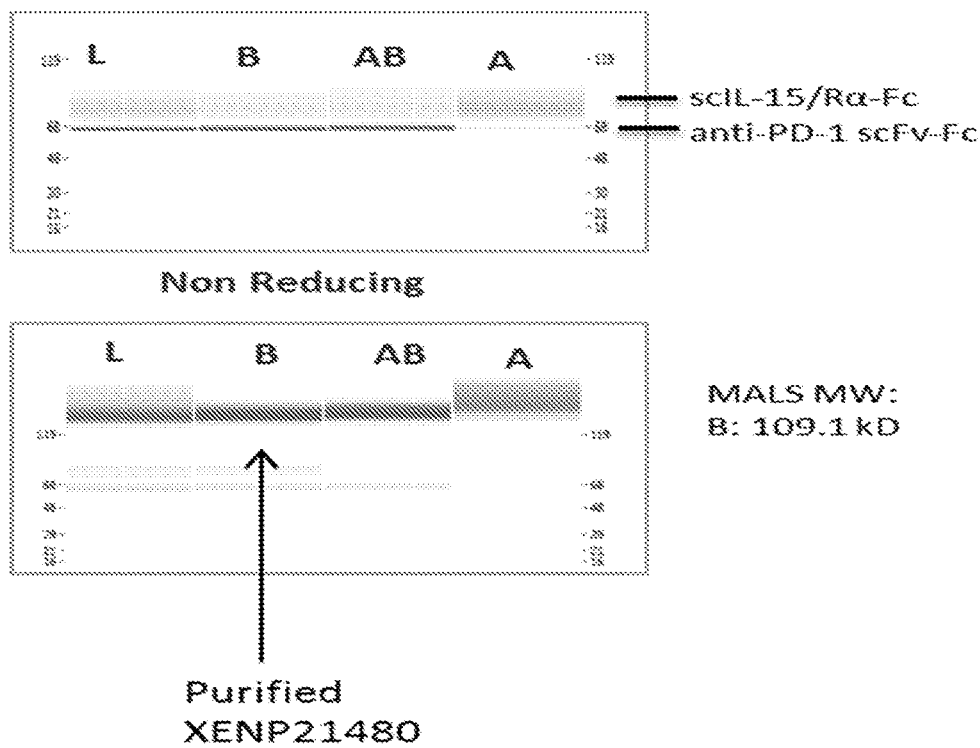

The proteins were analyzed electrophoretically via CEF using LabChip GXII Touch HT (PerkinElmer, Waltham, Mass.) using Protein Express Assay LabChip and Protein Express Assay Reagent Kit carried out using the manufacturer's instructions. Samples were run in duplicate, one under reducing (with dithiothreitol) and the other under non-reducing conditions. Gel image for XENP21480 is shown in FIG. 76C.

Figure 76D:
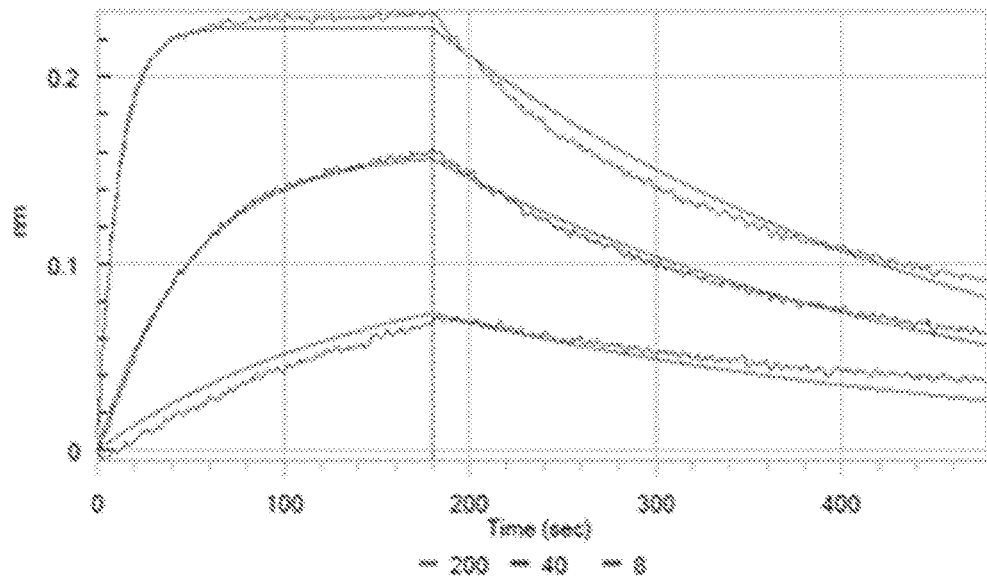
Figure 76E:
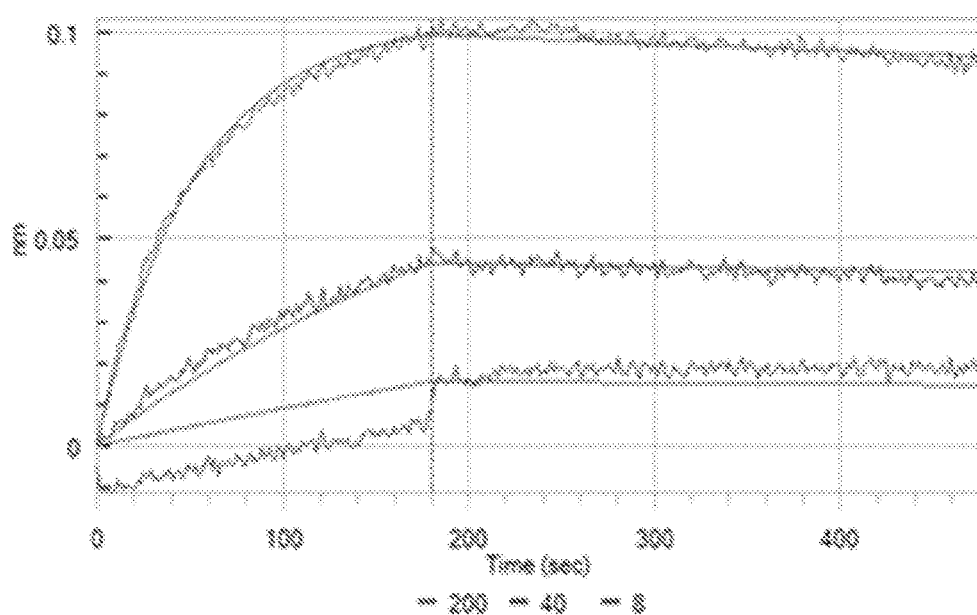

Affinity screens of the bifunctional proteins for IL-2Rβ and PD-1 were performed using Octet as generally described in Example 1B(a). In a first screen, anti-human Fc (AHC) biosensors were used to capture the test articles and then dipped into multiple concentration of IL-2Rβ (R&D Systems, Minneapolis, Minn.) or histidine-tagged PD-1 for KD determination. The affinity result and corresponding sensorgrams for XENP21480 are depicted in FIGS. 76D-76E. In a second screen, a HIS1K biosensors were used to capture either histidine-tagged IL-2Rβ:common gamma chain complex-Fc fusion or histidine-tagged PD-1-Fc fusion and then dipped into 2 different batches of XENP25850, sensorgrams for which are depicted in FIG. 77.

Figure 76F:
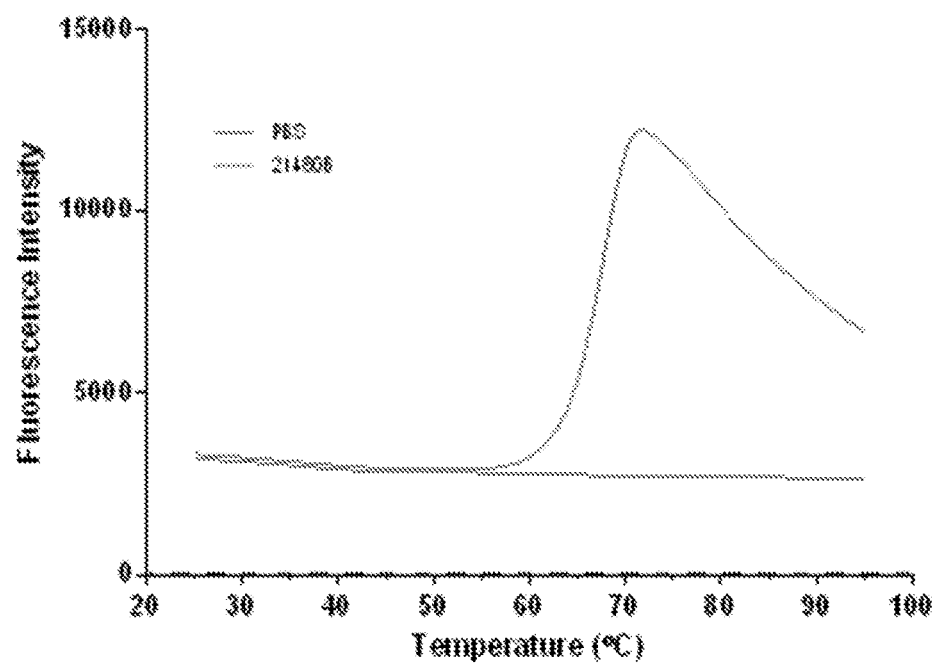

Stability of the bifunctional proteins were evaluated using Differential Scanning Fluorimetry (DSF). DSF experiments were performed using a Bio-Rad CFX Connect Real-Time PCR Detection System. Proteins were mixed with SYPRO Orange fluorescent dye and diluted to 0.2 mg/mL in PBS. The final concentration of SYPRO Orange was 10×. After an initial 10 minute incubation period at 25° C., proteins were heated from 25 to 95° C. using a heating rate of 1° C./min. A fluorescence measurement was taken every 30 sec. Melting temperatures (Tm) were calculated using the instrument software. The stability result and corresponding melting curve for XENP21480 are depicted in FIG. 76F.

B. 3B: Activity of IL-15/Rα×Anti-PD-1 Bifunctionals in Cell Proliferation Assays An illustrative IL-15/Rα×anti-PD-1 bifunctional protein XENP21480 and controls were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cy5.5 (OKT4), anti-CD27-PE (M-T271), anti-CD56-BV421 (5.1H11), anti-CD16-BV421 (3G8), and anti-CD45RA-BV605 (Hi100) to gate for the following cell types: CD4+ T cells, CD8+ T cells, and NK cells (CD56+/CD16+). Ki67 is a protein strictly associated with cells proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIGS. 78A-78C).

C. 3C: Activity of IL-15/Rα×Anti-PD-1 Bifunctionals in an SEB-Stimulated PBMC Assay Human PBMCs from multiple donors were stimulated with 10 ng/mL of SEB for 72 hours in combination with 20 μg/mL of an illustrative IL-15/Rα×anti-PD-1 bifunctional protein or controls. After treatment, supernatant was collected and assayed for IL-2, data for which is depicted in FIG. 79.

D. 3D: IL-15/Rα×Anti-PD-1 Bifunctionals Enhance Engraftment and Disease Activity in Human PBMC-Engrafted NSG Mice An illustrative IL-15/Rα×anti-PD-1 was evaluated in a Graft-versus-Host Disease (GVHD) model conducted in NSG (NOD-SCID-gamma) immunodeficient mice. When the NSG mice are injected with human PBMCs, the human PBMCs develop an autoimmune response against mouse cells. Treatment of NSG mice injected with human PBMCs followed with IL-15/Rα×anti-PD-1 de-repress and proliferate the engrafted T cells and enhances engraftment.

10 million human PBMCs were engrafted into NSG mice via IV-OSP on Day −8 followed by dosing with the indicated test articles at the indicated concentrations on Day 0. IFNγ levels and human CD45+ lymphocytes, CD8+ T cell and CD4+ T cell counts were measured at Days 4, 7, and 11. FIG. 80 depicts IFNγ levels in mice serum on Days 4, 7, and 11. FIGS. 81A-81C respectively depict CD8+ T cell counts on Days 4, 7, and 11. FIGS. 82A-82C respectively depict CD4+ T cell counts on Days 4, 7, and 11. FIGS. 83A-83C respectively depict CD45+ cell counts on Days 4, 7, and 11. Body weight of the mice were also measured on Days 4, 7, and 11 and depicted as percentage of initial body weight in FIG. 84.

SEQUENCE LISTING (1546 sequences)

SEQ ID NO: 1 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 4 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 5 - protein, 20 aa, Artificial Sequence
  Description of Artificial Sequence: Synthetic peptide
GKPGSGKPGSGKPGSGKPGS

SEQ ID NO: 6 - protein, 6 aa, Artificial Sequence
  Description of Artificial Sequence: Synthetic 6xHis tag
HHHHHH

SEQ ID NO: 7 - protein, 10 aa, Artificial Sequence
  Description of Artificial Sequence: Synthetic peptide
  MISC_FEATURE (1)..(10): This sequence may encompass 1-5 "Gly Ser" repeating units
GSGSGSGSGS

SEQ ID NO: 8 - protein, 25 aa, Artificial Sequence
  Description of Artificial Sequence: Synthetic peptide
  MISC_FEATURE (1)..(25): This sequence may encompass 1-5 "Gly Ser Gly Gly Ser" repeating units
GSGGSGSGGSGSGGSGSGGSGSGGS

SEQ ID NO: 9 - protein, 25 aa, Artificial Sequence
  Description of Artificial Sequence: Synthetic peptide
  MISC_FEATURE (1)..(25): This sequence may encompass 1-5 "Gly Gly Gly Gly Ser" repeating units
GGGGSGGGGSGGGGSGGGGSGGGGS

SEQ ID NO: 10 - protein, 20 aa, Artificial Sequence
  Description of Artificial Sequence: Synthetic peptide
  MISC_FEATURE (1)..(20): This sequence may encompass 1-5 "Gly Gly Gly Ser" repeating units
GGGSGGGSGGGSGGGSGGGS

SEQ ID NO: 11 - protein, 8 aa, Artificial Sequence
  Description of Artificial Sequence: Synthetic peptide
  MISC_FEATURE (1)..(8): This sequence may encompass 1-4 "Gly Ser" repeating units
GSGSGSGS

SEQ ID NO: 12 - protein, 20 aa, Artificial Sequence
  Description of Artificial Sequence: Synthetic peptide
  MISC_FEATURE (1)..(20): This sequence may encompass 1-4 "Gly Ser Gly Gly Ser" repeating units
GSGGSGSGGSGSGGSGSGGS

SEQ ID NO: 13 - protein, 20 aa, Artificial Sequence
  Description of Artificial Sequence: Synthetic peptide
  MISC_FEATURE (1)..(20): This sequence may encompass 1-4 "Gly Gly Gly Gly Ser" repeating units
GGGGSGGGGSGGGGSGGGGS

SEQ ID NO: 14 - protein, 16 aa, Artificial Sequence
  Description of Artificial Sequence: Synthetic peptide
  MISC_FEATURE (1)..(16): This sequence may encompass 1-4 "Gly Gly Gly Ser" repeating units
GGGSGGGSGGGSGGGS

SEQ ID NO: 15 - protein, 4 aa, Artificial Sequence
  Description of Artificial Sequence: Synthetic peptide
EPKS

SEQ ID NO: 16 - protein, 162 aa, Homo sapiens; identical to SEQ ID NO: 1

SEQ ID NO: 17 - protein, 114 aa, Homo sapiens; identical to SEQ ID NO: 2

SEQ ID NO: 18 - protein, 267 aa, Homo sapiens; identical to SEQ ID NO: 3

SEQ ID NO: 19 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 20 - protein, 65 aa, Homo sapiens; identical to SEQ ID NO: 4

SEQ ID NO: 21 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 22 - protein, 214 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 23 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 24 - protein, 240 aa, Homo sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 25 - protein, 5 aa, Artificial Sequence
  Description of Artificial Sequence: Synthetic peptide
GGGGS

SEQ ID NO: 26 - protein, 10 aa, Artificial Sequence
  Description of Artificial Sequence: Synthetic peptide
GGGGSGGGGS

SEQ ID NO: 27 - protein, 15 aa, Artificial Sequence
  Description of Artificial Sequence: Synthetic peptide
GGGGSGGGGSGGGGS

SEQ ID NO: 28 - protein, 20 aa, Artificial Sequence
  Description of Artificial Sequence: Synthetic peptide
GGGGSGGGGSGGGGSGGGGS

SEQ ID NO: 29 - protein, 25 aa, Artificial Sequence
  Description of Artificial Sequence: Synthetic peptide
GGGGSGGGGSGGGGSGGGGSGGGGS

SEQ ID NO: 30 - protein, 30 aa, Artificial Sequence
  Description of Artificial Sequence: Synthetic polypeptide
GGGGSGGGGSGGGGSGGGGSGGGGSGGGGS

SEQ ID NO: 31 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 32 - protein, 30 aa, Artificial Sequence
  Description of Artificial Sequence: Synthetic polypeptide
DPALVHQRPAPPGGGGSGGGGSGGGGSGGG

SEQ ID NO: 33 - protein, 5 aa, Artificial Sequence
  Description of Artificial Sequence: Synthetic peptide
GKPGS

SEQ ID NO: 34 - protein, 25 aa, Artificial Sequence
  Description of Artificial Sequence: Synthetic peptide
GKPGSGKPGSGKPGSGKPGSGKPGS

SEQ ID NO: 35 - protein, 30 aa, Artificial Sequence
  Description of Artificial Sequence: Synthetic polypeptide
GKPGSGKPGSGKPGSGKPGSGKPGSGKPGS

SEQ ID NO: 36 - protein, 5 aa, Artificial Sequence
  Description of Artificial Sequence: Synthetic peptide
GGGES

SEQ ID NO: 37 - protein, 15 aa, Artificial Sequence
  Description of Artificial Sequence: Synthetic peptide
GGGGSGGGGSGGGGS

SEQ ID NO: 38 - protein, 18 aa, Artificial Sequence
  Description of Artificial Sequence: Synthetic peptide
GSTSGSGKPGSGEGSTKG

SEQ ID NO: 39 - protein, 14 aa, Artificial Sequence
  Description of Artificial Sequence: Synthetic peptide
IRPRAIGGSKPRVA

SEQ ID NO: 40 - protein, 15 aa, Artificial Sequence
  Description of Artificial Sequence: Synthetic peptide
GKGGSGKGGSGKGGS

SEQ ID NO: 41 - protein, 15 aa, Artificial Sequence
  Description of Artificial Sequence: Synthetic peptide
GGKGSGGKGSGGKGS

SEQ ID NO: 42 - protein, 15 aa, Artificial Sequence
  Description of Artificial Sequence: Synthetic peptide
GGGKSGGGKSGGGKS

SEQ ID NO: 43 - protein, 15 aa, Artificial Sequence
  Description of Artificial Sequence: Synthetic peptide
GKGKSGKGKSGKGKS

SEQ ID NO: 44 - protein, 15 aa, Artificial Sequence
  Description of Artificial Sequence: Synthetic peptide
GGGKSGGKGSGKGGS

SEQ ID NO: 45 - protein, 15 aa, Artificial Sequence
  Description of Artificial Sequence: Synthetic peptide
GKPGSGKPGSGKPGS

SEQ ID NO: 46 - protein, 20 aa, Artificial Sequence
  Description of Artificial Sequence: Synthetic peptide
GKPGSGKPGSGKPGSGKPGS

SEQ ID NO: 47 - protein, 20 aa, Artificial Sequence
  Description of Artificial Sequence: Synthetic peptide
GKGKSGKGKSGKGKSGKGKS

SEQ ID NO: 48 - protein, 20 aa, Artificial Sequence
  Description of Artificial Sequence: Synthetic peptide
GGGGSGGGGSGGGGSGGGGS

SEQ ID NO: 49 - protein, 14 aa, Artificial Sequence
  Description of Artificial Sequence: Synthetic peptide
STAGDTHLGGEDFD

SEQ ID NO: 50 - protein, 15 aa, Artificial Sequence
  Description of Artificial Sequence: Synthetic peptide
GEGGSGEGGSGEGGS

SEQ ID NO: 51 - protein, 15 aa, Artificial Sequence
  Description of Artificial Sequence: Synthetic peptide
GGEGSGGEGSGGEGS

SEQ ID NO: 52 - protein, 15 aa, Artificial Sequence
  Description of Artificial Sequence: Synthetic peptide
GGGESGGGESGGGES

SEQ ID NO: 53 - protein, 15 aa, Artificial Sequence
  Description of Artificial Sequence: Synthetic peptide
GEGESGEGESGEGES

SEQ ID NO: 54 - protein, 15 aa, Artificial Sequence
  Description of Artificial Sequence: Synthetic peptide
GGGESGGEGSGEGGS

SEQ ID NO: 55 - protein, 20 aa, Artificial Sequence
  Description of Artificial Sequence: Synthetic peptide
GEGESGEGESGEGESGEGES

SEQ ID NO: 56 - protein, 15 aa, Artificial Sequence
  Description of Artificial Sequence: Synthetic peptide
GGGGSGGGGSGGGGS

SEQ ID NO: 57 - protein, 20 aa, Artificial Sequence
  Description of Artificial Sequence: Synthetic peptide
GGGGSGGGGSGGGGSGGGGS

SEQ ID NO: 58 - protein, 18 aa, Artificial Sequence
  Description of Artificial Sequence: Synthetic peptide
GSTSGSGKPGSGEGSTKG

SEQ ID NO: 59 - protein, 19 aa, Artificial Sequence
  Description of Artificial Sequence: Synthetic peptide
PRGASKSGSASQTGSAPGS

SEQ ID NO: 60 - protein, 19 aa, Artificial Sequence
  Description of Artificial Sequence: Synthetic peptide
GTAAAGAGAAGGAAAGAAG

SEQ ID NO: 61 - protein, 19 aa, Artificial Sequence
  Description of Artificial Sequence: Synthetic peptide
GTSGSSGSGSGGSGSGGGG

SEQ ID NO: 62 - protein, 20 aa, Artificial Sequence
  Description of Artificial Sequence: Synthetic peptide
GKPGSGKPGSGKPGSGKPGS

SEQ ID NO: 63 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 65 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 231 aa, Artificial Sequence; identical to SEQ ID NO: 64
  Description of Artificial Sequence: Synthetic polypeptide
  IL-15/Ralpha-Fc monomer 2

SEQ ID NO: 67 - protein, 231 aa, Artificial Sequence; identical to SEQ ID NO: 65
  Description of Artificial Sequence: Synthetic polypeptide
  IL-15/Ralpha-Fc monomer 1

SEQ ID NO: 68 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 69 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 70 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 71 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 73 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 75 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 77 - protein, 229 aa, Artificial Sequence
  Description of Artificial Sequence: Synthetic polypeptide
  IL-15/Ralpha-Fc monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 78 - protein, 229 aa, Artificial Sequence
  Description of Artificial Sequence: Synthetic polypeptide
  IL-15/Ralpha-Fc monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 79 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 80 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 81 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 82 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 83 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 84 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 85 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 231 aa, Artificial Sequence; identical to SEQ ID NO: 85
  Description of Artificial Sequence: Synthetic polypeptide
  IL-15/Ralpha-Fc monomer 2

SEQ ID NO: 87 - protein, 231 aa, Artificial Sequence; identical to SEQ ID NO: 64
  Description of Artificial Sequence: Synthetic polypeptide
  IL-15/Ralpha-Fc monomer 1

SEQ ID NO: 88 - protein, 231 aa, Artificial Sequence
  Description of Artificial Sequence: Synthetic polypeptide
  IL-15/Ralpha-Fc monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 329 aa, Artificial Sequence
  Description of Artificial Sequence: Synthetic polypeptide
  IL-15/Ralpha x anti-PD-1 Backbone 1 Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 231 aa, Artificial Sequence; identical to SEQ ID NO: 64
  Description of Artificial Sequence: Synthetic polypeptide
  IL-15/Ralpha x anti-PD-1 Backbone 1 Chain 2

SEQ ID NO: 91 - protein, 329 aa, Artificial Sequence
  Description of Artificial Sequence: Synthetic polypeptide
  IL-15/Ralpha x anti-PD-1 Backbone 2 Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 92 - protein, 231 aa, Artificial Sequence; identical to SEQ ID NO: 63
  Description of Artificial Sequence: Synthetic polypeptide
  IL-15/Ralpha x anti-PD-1 Backbone 2 Chain 2

SEQ ID NO: 93 - protein, 329 aa, Artificial Sequence; identical to SEQ ID NO: 91
  Description of Artificial Sequence: Synthetic polypeptide
  IL-15/Ralpha x anti-PD-1 Backbone 3 Chain 1

SEQ ID NO: 94 - protein, 329 aa, Artificial Sequence
  Description of Artificial Sequence: Synthetic polypeptide
  IL-15/Ralpha x anti-PD-1 Backbone 3 Chain 2
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 107 aa, Artificial Sequence [sequence omitted]

SEQ ID NO: 96 - protein, 106 aa, Artificial Sequence
  Description of Artificial Sequence: Synthetic polypeptide
  Constant Light Chain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 97 - protein, 113 aa, Artificial Sequence [sequence omitted]

SEQ ID NO: 98 - protein, 5 aa, Artificial Sequence
  Description of Artificial Sequence: Synthetic peptide
  XENP016432 vhCDR1
NSGMH

SEQ ID NO: 99 - protein, 17 aa, Artificial Sequence
  Description of Artificial Sequence: Synthetic peptide
  XENP016432 vhCDR2
VIWYDGSKRYYADSVKG

SEQ ID NO: 100 - protein, 4 aa, Artificial Sequence
  Description of Artificial Sequence: Synthetic peptide
  XENP016432 vhCDR3
NDDY

SEQ ID NO: 101 - protein, 442 aa, Artificial Sequence
  Description of Artificial Sequence: Synthetic polypeptide
  HC of XENP016432
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 107 aa, Artificial Sequence [sequence omitted]

SEQ ID NO: 103 - protein, 11 aa, Artificial Sequence
  Description of Artificial Sequence: Synthetic peptide
  XENP016432 vlCDR1
RASQSVSSYLA

SEQ ID NO: 104 - protein, 7 aa, Artificial Sequence
  Description of Artificial Sequence: Synthetic peptide
  XENP016432 vlCDR2
DASNRAT

SEQ ID NO: 105 - protein, 9 aa, Artificial Sequence
  Description of Artificial Sequence: Synthetic peptide
  XENP016432 vlCDR3
QQSSNWPRT

SEQ ID NO: 106 - protein, 214 aa, Artificial Sequence
  Description of Artificial Sequence: Synthetic polypeptide
  LC of XENP016432
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 127 aa, Artificial Sequence
  Description of Artificial Sequence: Synthetic polypeptide
  VH of XENP024120
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSS

SEQ ID NO: 108 - protein, 7 aa, Artificial Sequence
  Description of Artificial Sequence: Synthetic peptide
  XENP024120 vhCDR1
SGAYYWS

SEQ ID NO: 109 - protein, 16 aa, Artificial Sequence
  Description of Artificial Sequence: Synthetic peptide
  XENP024120 vhCDR2
YIYYNGNTYYNPSLRS

SEQ ID NO: 110 - protein, 17 aa, Artificial Sequence
  Description of Artificial Sequence: Synthetic peptide
  XENP024120 vhCDR3
ASDYVWGGYHYFDAFDL

SEQ ID NO: 111 - protein, 456 aa, Artificial Sequence
  Description of Artificial Sequence: Synthetic polypeptide
  HC of XENP024120
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 110 aa, Artificial Sequence
  Description of Artificial Sequence: Synthetic polypeptide
  VL of XENP024120
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL

SEQ ID NO: 113 - protein, 13 aa, Artificial Sequence
  Description of Artificial Sequence: Synthetic peptide
  XENP024120 vlCDR1
SGSNSNIGSNSVN

SEQ ID NO: 114 - protein, 7 aa, Artificial Sequence
  Description of Artificial Sequence: Synthetic peptide
  XENP024120 vlCDR2
GNNQRPS

SEQ ID NO: 115 - protein, 11 aa, Artificial Sequence
  Description of Artificial Sequence: Synthetic peptide
  XENP024120 vlCDR3
AAWDDSLNGPV

SEQ ID NO: 116 - protein, 216 aa, Artificial Sequence
  Description of Artificial Sequence: Synthetic polypeptide
  LC of XENP024120
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 117 - protein, 123 aa, Artificial Sequence
  Description of Artificial Sequence: Synthetic polypeptide
  VH of XENP024121
QVQLQQPGTELMKPGASVKLSCKASGYTFTTYWMHWVKQRPGQGLEWIGEIDPSDSYVNYNQNFKGKATLTVDKSSSTAYIQLSSLTSEDSAVYFCARSPDYYGTSLAWFDYWGQGTLVTVST

SEQ ID NO: 118 - protein, 5 aa, Artificial Sequence
  Description of Artificial Sequence: Synthetic peptide
  XENP024121 vhCDR1
TYWMH

SEQ ID NO: 119 - protein, 17 aa, Artificial Sequence
  Description of Artificial Sequence: Synthetic peptide
  XENP024121 vhCDR2
EIDPSDSYVNYNQNFKG

SEQ ID NO: 120 - protein, 14 aa, Artificial Sequence
  Description of Artificial Sequence: Synthetic peptide
  XENP024121 vhCDR3
SPDYYGTSLAWFDY

SEQ ID NO: 121 - protein, 452 aa, Artificial Sequence
  Description of Artificial Sequence: Synthetic polypeptide
  HC of XENP024121
QVQLQQPGTELMKPGASVKLSCKASGYTFTTYWMHWVKQRPGQGLEWIGEIDPSDSYVNYNQNFKGKATLTVDKSSSTAYIQLSSLTSEDSAVYFCARSPDYYGTSLAWFDYWGQGTLVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 122 - protein, 111 aa, Artificial Sequence
  Description of Artificial Sequence: Synthetic polypeptide
  VL of XENP024121
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIK

SEQ ID NO: 123 - protein, 15 aa, Artificial Sequence
  Description of Artificial Sequence: Synthetic peptide
  XENP024121 vlCDR1
RASESVDNYGMSFMN

SEQ ID NO: 124 - protein, 7 aa, Artificial Sequence
  Description of Artificial Sequence: Synthetic peptide
  XENP024121 vlCDR2
AASNQGS

SEQ ID NO: 125 - protein, 9 aa, Artificial Sequence
  Description of Artificial Sequence: Synthetic peptide
  XENP024121 vlCDR3
QQSKEVPYT

SEQ ID NO: 126 - protein, 218 aa, Artificial Sequence
  Description of Artificial Sequence: Synthetic polypeptide
  LC of XENP024121
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 122 aa, Artificial Sequence
  Description of Artificial Sequence: Synthetic polypeptide
  VH of XENP019686
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 128 - protein, 5 aa, Artificial Sequence
  Description of Artificial Sequence: Synthetic peptide
  XENP019686 vhCDR1
NYWMN

SEQ ID NO: 129 - protein, 19 aa, Artificial Sequence
  Description of Artificial Sequence: Synthetic peptide
  XENP019686 vhCDR2
EIRLYSNNYATHYAESVKG

SEQ ID NO: 130 - protein, 11 aa, Artificial Sequence
  Description of Artificial Sequence: Synthetic peptide
  XENP019686 vhCDR3
YYGNYGGYFDV

SEQ ID NO: 131 - protein, 451 aa, Artificial Sequence
  Description of Artificial Sequence: Synthetic polypeptide
  HC of XENP019686
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 107 aa, Artificial Sequence
  Description of Artificial Sequence: Synthetic polypeptide
  VL of XENP019686
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 133 - protein, 11 aa, Artificial Sequence
  Description of Artificial Sequence: Synthetic peptide
  XENP019686 vlCDR1
RASQSVGNDVA

SEQ ID NO: 134 - protein, 7 aa, Artificial Sequence
  Description of Artificial Sequence: Synthetic peptide
  XENP019686 vlCDR2
YASHRYT

SEQ ID NO: 135 - protein, 9 aa, Artificial Sequence
  Description of Artificial Sequence: Synthetic peptide
  XENP019686 vlCDR3
QQDFSSPRT

SEQ ID NO: 136 - protein, 214 aa, Artificial Sequence
  Description of Artificial Sequence: Synthetic polypeptide
  LC of XENP019686
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 120 aa, Artificial Sequence
  Description of Artificial Sequence: Synthetic polypeptide
  VH of XENP020156
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS

SEQ ID NO: 138 - protein, 5 aa, Artificial Sequence
  Description of Artificial Sequence: Synthetic peptide
  XENP020156 vhCDR1
NYWLG

SEQ ID NO: 139 - protein, 17 aa, Artificial Sequence
  Description of Artificial Sequence: Synthetic peptide
  XENP020156 vhCDR2
NFYPGSSNTYYNEKFQG

SEQ ID NO: 140 - protein, 11 aa, Artificial Sequence
  Description of Artificial Sequence: Synthetic peptide
  XENP020156 vhCDR3
HYGTNYRYFDV

SEQ ID NO: 141 - protein, 449 aa, Artificial Sequence
  Description of Artificial Sequence: Synthetic polypeptide
  HC of XENP020156
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 142 - protein, 107 aa, Artificial Sequence
  Description of Artificial Sequence: Synthetic polypeptide
  VL of XENP020156
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 143 - protein, 11 aa, Artificial Sequence
  Description of Artificial Sequence: Synthetic peptide
  XENP020156 vlCDR1
RASQSVSNDVA

SEQ ID NO: 144 - protein, 7 aa, Artificial Sequence
  Description of Artificial Sequence: Synthetic peptide
  XENP020156 vlCDR2
YASNRYT

SEQ ID NO: 145 - protein, 9 aa, Artificial Sequence
  Description of Artificial Sequence: Synthetic peptide
  XENP020156 vlCDR3
QQDYSSPYT

SEQ ID NO: 146 - protein, 214 aa, Artificial Sequence
  Description of Artificial Sequence: Synthetic polypeptide
  LC of XENP020156
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 122 aa, Artificial Sequence; identical to SEQ ID NO: 127
  Description of Artificial Sequence: Synthetic polypeptide
  VH of XENP19690

SEQ ID NO: 148 - protein, 5 aa, Artificial Sequence
  Description of Artificial Sequence: Synthetic peptide
  XENP19690 vhCDR1
NYWMN

SEQ ID NO: 149 - protein, 19 aa, Artificial Sequence
  Description of Artificial Sequence: Synthetic peptide
  XENP19690 vhCDR2
EIRLYSNNYATHYAESVKG

SEQ ID NO: 150 - protein, 11 aa, Artificial Sequence
  Description of Artificial Sequence: Synthetic peptide
  XENP19690 vhCDR3
YYGNYGGYFDV

SEQ ID NO: 151 - protein, 107 aa, Artificial Sequence; identical to SEQ ID NO: 132
  Description of Artificial Sequence: Synthetic polypeptide
  VL of XENP19690

SEQ ID NO: 152 - protein, 11 aa, Artificial Sequence
  Description of Artificial Sequence: Synthetic peptide
  XENP19690 vlCDR1
RASQSVGNDVA

SEQ ID NO: 153 - protein, 7 aa, Artificial Sequence
  Description of Artificial Sequence: Synthetic peptide
  XENP19690 vlCDR2
YASHRYT

SEQ ID NO: 154 - protein, 9 aa, Artificial Sequence
  Description of Artificial Sequence: Synthetic peptide
  XENP19690 vlCDR3
QQDFSSPRT

SEQ ID NO: 155 - protein, 249 aa, Artificial Sequence
  Description of Artificial Sequence: Synthetic polypeptide
  scFv of XENP19690
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 156 - protein, 122 aa, Artificial Sequence
  Description of Artificial Sequence: Synthetic polypeptide
  VH of 1G6_H1.280_L1.224 anti-PD-1 Fv
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 157 - protein, 5 aa, Artificial Sequence
  Description of Artificial Sequence: Synthetic peptide
  1G6_H1.280_L1.224 anti-PD-1 Fv vhCDR1
NYWMN

SEQ ID NO: 158 - protein, 19 aa, Artificial Sequence
  Description of Artificial Sequence: Synthetic peptide
  1G6_H1.280_L1.224 anti-PD-1 Fv vhCDR2
EIRLYSNNYATHYAESVKG

SEQ ID NO: 159 - protein, 11 aa, Artificial Sequence
  Description of Artificial Sequence: Synthetic peptide
  1G6_H1.280_L1.224 anti-PD-1 Fv vhCDR3
YYGNYGGYFDV

SEQ ID NO: 160 - protein, 107 aa, Artificial Sequence
  Description of Artificial Sequence: Synthetic polypeptide
  VL of 1G6_H1.280_L1.224 anti-PD-1 Fv
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 161 - protein, 11 aa, Artificial Sequence
  Description of Artificial Sequence: Synthetic peptide
  1G6_H1.280_L1.224 anti-PD-1 Fv vlCDR1
RASQSVGNDVA

SEQ ID NO: 162 - protein, 7 aa, Artificial Sequence
  Description of Artificial Sequence: Synthetic peptide
  1G6_H1.280_L1.224 anti-PD-1 Fv vlCDR2
YASHRYT

SEQ ID NO: 163 - protein, 9 aa, Artificial Sequence
  Description of Artificial Sequence: Synthetic peptide
  1G6_H1.280_L1.224 anti-PD-1 Fv vlCDR3
QQDWSSPRT

SEQ ID NO: 164 - protein, 249 aa, Artificial Sequence
  Description of Artificial Sequence: Synthetic polypeptide
  scFv of 1G6_H1.280_L1.224 anti-PD-1 Fv
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 165 - protein, 107 aa, Artificial Sequence; identical to SEQ ID NO: 132
  Description of Artificial Sequence: Synthetic polypeptide
  VH of XENP19692

SEQ ID NO: 166 - protein, 11 aa, Artificial Sequence
  Description of Artificial Sequence: Synthetic peptide
  XENP19692 vhCDR1
RASQSVGNDVA

SEQ ID NO: 167 - protein, 7 aa, Artificial Sequence
  Description of Artificial Sequence: Synthetic peptide
  XENP19692 vhCDR2
YASHRYT

SEQ ID NO: 168 - protein, 9 aa, Artificial Sequence
  Description of Artificial Sequence: Synthetic peptide
  XENP19692 vhCDR3
QQDFSSPRT

SEQ ID NO: 169 - protein, 122 aa, Artificial Sequence; identical to SEQ ID NO: 127
  Description of Artificial Sequence: Synthetic polypeptide
  VL of XENP19692

SEQ ID NO: 170 - protein, 5 aa, Artificial Sequence
  Description of Artificial Sequence: Synthetic peptide
  XENP19692 vlCDR1
NYWMN

SEQ ID NO: 171 - protein, 19 aa, Artificial Sequence
  Description of Artificial Sequence: Synthetic peptide
  XENP19692 vlCDR2
EIRLYSNNYATHYAESVKG

SEQ ID NO: 172 - protein, 11 aa, Artificial Sequence
  Description of Artificial Sequence: Synthetic peptide
  XENP19692 vlCDR3
YYGNYGGYFDV

SEQ ID NO: 173 - protein, 249 aa, Artificial Sequence
  Description of Artificial Sequence: Synthetic polypeptide
  scFv of XENP19692
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 174 - protein, 107 aa, Artificial Sequence
  Description of Artificial Sequence: Synthetic polypeptide
  VH of XENP19669
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK

SEQ ID NO: 175 - protein, 11 aa, Artificial Sequence
  Description of Artificial Sequence: Synthetic peptide
  XENP19669 vhCDR1
RASQSVGNDVA

SEQ ID NO: 176 - protein, 7 aa, Artificial Sequence
  Description of Artificial Sequence: Synthetic peptide
  XENP19669 vhCDR2
YASHRYT

SEQ ID NO: 177 - protein, 9 aa, Artificial Sequence
  Description of Artificial Sequence: Synthetic peptide
  XENP19669 vhCDR3
QQDFSSPRT

SEQ ID NO: 178 - protein, 122 aa, Artificial Sequence
  Description of Artificial Sequence: Synthetic polypeptide
  VL of XENP19669
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 179 - protein, 5 aa, Artificial Sequence
  Description of Artificial Sequence: Synthetic peptide
  XENP19669 vlCDR1
NYWMN

SEQ ID NO: 180 - protein, 19 aa, Artificial Sequence
  Description of Artificial Sequence: Synthetic peptide
  XENP19669 vlCDR2
EIRLYSNNYATHYAESVKG

SEQ ID NO: 181 - protein, 11 aa, Artificial Sequence
  Description of Artificial Sequence: Synthetic peptide
  XENP19669 vlCDR3
YYGNYGGYFDV

SEQ ID NO: 182 - protein, 249 aa, Artificial Sequence
  Description of Artificial Sequence: Synthetic polypeptide
  scFv of XENP19669
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 183 - protein, 120 aa, Artificial Sequence; identical to SEQ ID NO: 137
  Description of Artificial Sequence: Synthetic polypeptide
  VH of XENP20162

SEQ ID NO: 184 - protein, 5 aa, Artificial Sequence
  Description of Artificial Sequence: Synthetic peptide
  XENP20162 vhCDR1
NYWLG

SEQ ID NO: 185 - protein, 17 aa, Artificial Sequence
  Description of Artificial Sequence: Synthetic peptide
  XENP20162 vhCDR2
NFYPGSSNTYYNEKFQG

SEQ ID NO: 186 - protein, 11 aa, Artificial Sequence
  Description of Artificial Sequence: Synthetic peptide
  XENP20162 vhCDR3
HYGTNYRYFDV

SEQ ID NO: 187 - protein, 107 aa, Artificial Sequence; identical to SEQ ID NO: 142
  Description of Artificial Sequence: Synthetic polypeptide
  VL of XENP20162

SEQ ID NO: 188 - protein, 11 aa, Artificial Sequence
  Description of Artificial Sequence: Synthetic peptide
  XENP20162 vlCDR1
RASQSVSNDVA

SEQ ID NO: 189 - protein, 7 aa, Artificial Sequence
  Description of Artificial Sequence: Synthetic peptide
  XENP20162 vlCDR2
YASNRYT

SEQ ID NO: 190 - protein, 9 aa, Artificial Sequence
  Description of Artificial Sequence: Synthetic peptide
  XENP20162 vlCDR3
QQDYSSPYT

SEQ ID NO: 191 - protein, 247 aa, Artificial Sequence
  Description of Artificial Sequence: Synthetic polypeptide
  scFv of XENP20162
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 192 - protein, 117 aa, Artificial Sequence
  Description of Artificial Sequence: Synthetic polypeptide
  VH of 1C11H3_L3 anti-PD-1 Fv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 193 - protein, 5 aa, Artificial Sequence
  Description of Artificial Sequence: Synthetic peptide
  1C11H3_L3 anti-PD-1 Fv vhCDR1
HYGMN

SEQ ID NO: 194 - protein, 17 aa, Artificial Sequence
  Description of Artificial Sequence: Synthetic peptide
  1C11H3_L3 anti-PD-1 Fv vhCDR2
WINTYTGEPTYADGFTG

SEQ ID NO: 195 - protein, 8 aa, Artificial Sequence
  Description of Artificial Sequence: Synthetic peptide
  1C11H3_L3 anti-PD-1 Fv vhCDR3
DYYGSSPY

SEQ ID NO: 196 - protein, 112 aa, Artificial Sequence
  Description of Artificial Sequence: Synthetic polypeptide
  VL of 1C11H3_L3 anti-PD-1 Fv
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 197 - protein, 16 aa, Artificial Sequence
  Description of Artificial Sequence: Synthetic peptide
  1C11H3_L3 anti-PD-1 Fv vlCDR1
KSSQSIVHSNGNTYLE

SEQ ID NO: 198 - protein, 7 aa, Artificial Sequence
  Description of Artificial Sequence: Synthetic peptide
  1C11H3_L3 anti-PD-1 Fv vlCDR2
KVSNRFS

SEQ ID NO: 199 - protein, 9 aa, Artificial Sequence
  Description of Artificial Sequence: Synthetic peptide
  1C11H3_L3 anti-PD-1 Fv vlCDR3
FQGSHVPNT

SEQ ID NO: 200 - protein, 249 aa, Artificial Sequence
  Description of Artificial Sequence: Synthetic polypeptide
  scFv of 1C11H3_L3 anti-PD-1 Fv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 201 - protein, 446 aa, Artificial Sequence
  Description of Artificial Sequence: Synthetic polypeptide
  XENP021575 1C11[PD-1]_H0L0_IgG1_PVA_/S267K Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 117 aa, Artificial Sequence
  Description of Artificial Sequence: Synthetic polypeptide
  VH of XENP021575
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSS

SEQ ID NO: 203 - protein, 5 aa, Artificial Sequence
  Description of Artificial Sequence: Synthetic peptide
  XENP021575 vhCDR1
HYGMN

SEQ ID NO: 204 - protein, 17 aa, Artificial Sequence
  Description of Artificial Sequence: Synthetic peptide
  XENP021575 vhCDR2
WINTYTGEPTYADDFKG

SEQ ID NO: 205 - protein, 8 aa, Artificial Sequence
  Description of Artificial Sequence: Synthetic peptide
  XENP021575 vhCDR3
DYYGSSPY

SEQ ID NO: 206 - protein, 219 aa, Artificial Sequence
  Description of Artificial Sequence: Synthetic polypeptide
  XENP021575 1C11[PD-1]_H0L0_IgG1_PVA_/S267K Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - protein, 112 aa, Artificial Sequence
  Description of Artificial Sequence: Synthetic polypeptide
  VL of XENP021575
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIK

SEQ ID NO: 208 - protein, 16 aa, Artificial Sequence
  Description of Artificial Sequence: Synthetic peptide
  XENP021575 vhCDR1
RSSQSIVHSNGNTYLE

SEQ ID NO: 209 - protein, 7 aa, Artificial Sequence
  Description of Artificial Sequence: Synthetic peptide
  XENP021575 vhCDR2
KVSNRFS

SEQ ID NO: 210 - protein, 9 aa, Artificial Sequence
  Description of Artificial Sequence: Synthetic peptide
  XENP021575 vhCDR3
FQGSHVPNT

SEQ ID NO: 211 - protein, 446 aa, Artificial Sequence
  Description of Artificial Sequence: Synthetic polypeptide
  XENP022856 1C11_H3L3_IgG1_PVA_/S267K/M428L/N434S Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 212 - protein, 117 aa, Artificial Sequence; identical to SEQ ID NO: 192
  Description of Artificial Sequence: Synthetic polypeptide
  VH of XENP022856

SEQ ID NO: 213 - protein, 5 aa, Artificial Sequence
  Description of Artificial Sequence: Synthetic peptide
  XENP022856 vhCDR1
HYGMN

SEQ ID NO: 214 - protein, 17 aa, Artificial Sequence
  Description of Artificial Sequence: Synthetic peptide
  XENP022856 vhCDR2
WINTYTGEPTYADGFTG

SEQ ID NO: 215 - protein, 8 aa, Artificial Sequence
  Description of Artificial Sequence: Synthetic peptide
  XENP022856 vhCDR3
DYYGSSPY

SEQ ID NO: 216 - protein, 219 aa, Artificial Sequence
  Description of Artificial Sequence: Synthetic polypeptide
  XENP022856 1C11_H3L3_IgG1_PVA_/S267K/M428L/N434S Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 112 aa, Artificial Sequence; identical to SEQ ID NO: 196
  Description of Artificial Sequence: Synthetic polypeptide
  VL of XENP022856

SEQ ID NO: 218 - protein, 16 aa, Artificial Sequence
  Description of Artificial Sequence: Synthetic peptide
  XENP022856 vlCDR1
KSSQSIVHSNGNTYLE

SEQ ID NO: 219 - protein, 7 aa, Artificial Sequence
  Description of Artificial Sequence: Synthetic peptide
  XENP022856 vlCDR2
KVSNRFS

SEQ ID NO: 220 - protein, 9 aa, Artificial Sequence
  Description of Artificial Sequence: Synthetic peptide
  XENP022856 vlCDR3
FQGSHVPNT

SEQ ID NO: 221 - protein, 350 aa, Artificial Sequence
  Description of Artificial Sequence: Synthetic polypeptide
  XENP20818 Chain 1 - human_IL15_(GGGGS)1_Fc(216)_IgG1_pI(-) _Isosteric_A_C220S/PVA_/S267K/L368D/K370S (15902)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 222 - protein, 114 aa, Artificial Sequence; identical to SEQ ID NO: 2
  Description of Artificial Sequence: Synthetic polypeptide
  XENP20818 human IL15

SEQ ID NO: 223 - protein, 231 aa, Artificial Sequence; identical to SEQ ID NO: 64
  Description of Artificial Sequence: Synthetic polypeptide
  Fc chain of XENP20818

SEQ ID NO: 224 - protein, 301 aa, Artificial Sequence
  Description of Artificial Sequence: Synthetic polypeptide
  XENP20818 Chain 2 - human_IL15Ralpha(Sushi)_(GGGGS)1_Fc(216) _IgG1_C220S/PVA_/S267K/S364K/E357Q (15908)
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 225 - protein, 65 aa, Artificial Sequence; identical to SEQ ID NO: 4
  Description of Artificial Sequence: Synthetic polypeptide
  XENP20818 human IL15Ralpha(Sushi)

SEQ ID NO: 226 - protein, 231 aa, Artificial Sequence; identical to SEQ ID NO: 63
  Description of Artificial Sequence: Synthetic polypeptide
  Fc chain of XENP20818

SEQ ID NO: 227 - protein, 345 aa, Artificial Sequence
  Description of Artificial Sequence: Synthetic polypeptide
  XENP21475 Chain 1 - human_IL15-Fc(216)_IgG1_pI(-)_Isosteric_A _C220S/PVA_/S267K/L368D/K370S (16479)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 228 - protein, 114 aa, Artificial Sequence; identical to SEQ ID NO: 2
  Description of Artificial Sequence: Synthetic polypeptide
  XENP21475 human IL15

SEQ ID NO: 229 - protein, 231 aa, Artificial Sequence; identical to SEQ ID NO: 64
  Description of Artificial Sequence: Synthetic polypeptide
  Fc chain of XENP21475

SEQ ID NO: 230 - protein, 296 aa, Artificial Sequence
  Description of Artificial Sequence: Synthetic polypeptide
  XENP21475 Chain 2 - human_IL15Ralpha(Sushi)-Fc(216)_IgG1 _C220S/PVA_/S267K/S364K/E357Q (16481)
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 65 aa, Artificial Sequence; identical to SEQ ID NO: 4
  Description of Artificial Sequence: Synthetic polypeptide
  XENP21475 human IL15Ralpha(Sushi)

SEQ ID NO: 232 - protein, 231 aa, Artificial Sequence; identical to SEQ ID NO: 63
  Description of Artificial Sequence: Synthetic polypeptide
  Fc chain of XENP21475

SEQ ID NO: 233 - protein, 440 aa, Artificial Sequence
  Description of Artificial Sequence: Synthetic polypeptide
  XENP21478 Chain 1 - human_IL15Ralpha(sushi)_(GGGGS)6-human _IL15-Fc(216)_IgG1_pI(-)_Isosteric_A_C220S/PVA _/S267K/L368D/K370S (16478)
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 234 - protein, 65 aa, Artificial Sequence; identical to SEQ ID NO: 4
  Description of Artificial Sequence: Synthetic polypeptide
  XENP21478 human IL15Ralpha(Sushi)

SEQ ID NO: 235 - protein, 114 aa, Artificial Sequence; identical to SEQ ID NO: 2
  Description of Artificial Sequence: Synthetic polypeptide
  XENP21478 human IL15

SEQ ID NO: 236 - protein, 231 aa, Artificial Sequence; identical to SEQ ID NO: 64
  Description of Artificial Sequence: Synthetic polypeptide
  Fc chain of XENP21478

SEQ ID NO: 237 - protein, 231 aa, Artificial Sequence; identical to SEQ ID NO: 63
  Description of Artificial Sequence: Synthetic polypeptide
  XENP21478 Chain 2 - empty-Fc(216)_IgG1_C220S/PVA _/S267K/S364K/E357Q (8924)

SEQ ID NO: 238 - protein, 114 aa, Artificial Sequence; identical to SEQ ID NO: 2
  Description of Artificial Sequence: Synthetic polypeptide
  XENP21479 Chain 1 - human_IL15_no_tag (16484)

SEQ ID NO: 239 - protein, 231 aa, Artificial Sequence; identical to SEQ ID NO: 64
  Description of Artificial Sequence: Synthetic polypeptide
  XENP21479 Chain 2 - empty-Fc(216)_IgG1_pI(-)_Isosteric_A _C220S/PVA_/S267K/L368D/K370S (8793)

SEQ ID NO: 240 - protein, 296 aa, Artificial Sequence; identical to SEQ ID NO: 230
  Description of Artificial Sequence: Synthetic polypeptide
  XENP21479 Chain 3 - human_IL15Ralpha(Sushi)-Fc(216)_IgG1 _C220S/PVA_/S267K/S364K/E357Q (16481)

SEQ ID NO: 241 - protein, 65 aa, Artificial Sequence; identical to SEQ ID NO: 4
  Description of Artificial Sequence: Synthetic polypeptide
  XENP21479 human IL15Ralpha(Sushi)

SEQ ID NO: 242 - protein, 231 aa, Artificial Sequence; identical to SEQ ID NO: 63
  Description of Artificial Sequence: Synthetic polypeptide
  Fc chain of XENP21479

SEQ ID NO: 243 - protein, 114 aa, Artificial Sequence; identical to SEQ ID NO: 2
  Description of Artificial Sequence: Synthetic polypeptide
  XENP022366 Chain 1 - human_IL15_no_tag (16484)

SEQ ID NO: 244 - protein, 231 aa, Artificial Sequence; identical to SEQ ID NO: 64
  Description of Artificial Sequence: Synthetic polypeptide
  XENP022366 Chain 2 - empty-Fc(216)_IgG1_pI(-)_Isosteric_A _C220S/PVA_/S267K/L368D/K370S (8793)

SEQ ID NO: 245 - protein, 301 aa, Artificial Sequence; identical to SEQ ID NO: 224
  Description of Artificial Sequence: Synthetic polypeptide
  XENP022366 Chain 3 - human_IL15Ralpha(Sushi)_(GGGGS)1_Fc(216) _IgG1_C220S/PVA_/S267K/S364K/E357Q (15908)

SEQ ID NO: 246 - protein, 65 aa, Artificial Sequence; identical to SEQ ID NO: 4
  Description of Artificial Sequence: Synthetic polypeptide
  XENP022366 human IL15Ralpha(Sushi)

SEQ ID NO: 247 - protein, 231 aa, Artificial Sequence; identical to SEQ ID NO: 63
  Description of Artificial Sequence: Synthetic polypeptide
  Fc chain of XENP022366

SEQ ID NO: 248 - protein, 114 aa, Artificial Sequence; identical to SEQ ID NO: 2
  Description of Artificial Sequence: Synthetic polypeptide
  XENP024348 Chain 1 - IL15 WT

SEQ ID NO: 249 - protein, 296 aa, Artificial Sequence
  Description of Artificial Sequence: Synthetic polypeptide
  XENP024348 Chain 2 - human_IL15Ralpha(Sushi)_Fc(216)_IgG1 _pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 250 - protein, 65 aa, Artificial Sequence; identical to SEQ ID NO: 4
  Description of Artificial Sequence: Synthetic polypeptide
  XENP024348 human IL15Ralpha(Sushi)

SEQ ID NO: 251 - protein, 231 aa, Artificial Sequence; identical to SEQ ID NO: 64
  Description of Artificial Sequence: Synthetic polypeptide
  Fc chain of XENP024348

SEQ ID NO: 252 - protein, 231 aa, Artificial Sequence; identical to SEQ ID NO: 63
  Description of Artificial Sequence: Synthetic polypeptide
  XENP024348 Chain 3 - empty_ Fc(216)_IgG1_C220S/PVA _/S267K/S364K/E357Q

SEQ ID NO: 253 - protein, 296 aa, Artificial Sequence
  Description of Artificial Sequence: Synthetic polypeptide
  XENP021978 Chain 1 - human_IL15Ralpha(Sushi)-Fc(216)_IgG1 _C220S/PVA_/S267K (17023)
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 65 aa, Artificial Sequence; identical to SEQ ID NO: 4
  Description of Artificial Sequence: Synthetic polypeptide
  XENP021978 human IL15Ralpha(Sushi)

SEQ ID NO: 255 - protein, 231 aa, Artificial Sequence; identical to SEQ ID NO: 85
  Description of Artificial Sequence: Synthetic polypeptide
  Fc chain of XENP021978

SEQ ID NO: 256 - protein, 114 aa, Artificial Sequence; identical to SEQ ID NO: 2
  Description of Artificial Sequence: Synthetic polypeptide
  XENP021978 Chain 2 - human_IL15_no_tag (16484)

SEQ ID NO: 257 - protein, 415 aa, Artificial Sequence
  Description of Artificial Sequence: Synthetic polypeptide
  human_IL15(single-chain)-human_IL15Ralpha(Sushi)_Fc(216)_IgG1 _C220S/PVA_/S267K
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 114 aa, Artificial Sequence; identical to SEQ ID NO: 2
  Description of Artificial Sequence: Synthetic polypeptide
  human_IL15(single-chain)-human_IL15Ralpha(Sushi)_Fc(216)_IgG1 _C220S/PVA_/S267K human IL15

SEQ ID NO: 259 - protein, 65 aa, Artificial Sequence; identical to SEQ ID NO: 4
  Description of Artificial Sequence: Synthetic polypeptide
  human_IL15(single-chain)-human_IL15Ralpha(Sushi)_Fc(216)_IgG1 _C220S/PVA_/S267K human IL15Ralpha(Sushi)

SEQ ID NO: 260 - protein, 231 aa, Artificial Sequence; identical to SEQ ID NO: 85
  Description of Artificial Sequence: Synthetic polypeptide
  Fc chain of human_IL15(single-chain)-human_IL15Ralpha(Sushi) _Fc(216)_IgG1_C220S/PVA_/S267K

SEQ ID NO: 261 - protein, 306 aa, Artificial Sequence
  Description of Artificial Sequence: Synthetic polypeptide
  XENP022637 Chain 1 - empty-Fc(216)_IgG1_pI(-)_Isosteric_A _C220S/PVA_/S267K/L368D/K370S_(GGGGS)2 _IL15Ralpha(Sushi) (17603)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 262 - protein, 231 aa, Artificial Sequence; identical to SEQ ID NO: 64
  Description of Artificial Sequence: Synthetic polypeptide
  Fc chain of XENP022637

SEQ ID NO: 263 - protein, 65 aa, Artificial Sequence; identical to SEQ ID NO: 4
  Description of Artificial Sequence: Synthetic polypeptide
  XENP022637 IL15Ralpha(Sushi)

SEQ ID NO: 264 - protein, 231 aa, Artificial Sequence; identical to SEQ ID NO: 88
  Description of Artificial Sequence: Synthetic polypeptide
  XENP022637 Chain 2 - empty-Fc(216)_IgG1_ISO(+RR)_C220S/PVA _/S267K/S364K/E357Q (8927)

SEQ ID NO: 265 - protein, 114 aa, Artificial Sequence; identical to SEQ ID NO: 2
  Description of Artificial Sequence: Synthetic polypeptide
  XENP022637 Chain 3 - human_IL15_no_tag (16484)

SEQ ID NO: 266 - protein, 425 aa, Artificial Sequence
  Description of Artificial Sequence: Synthetic polypeptide
  Chain 1 - empty-Fc(216)_IgG1_pI(-)_Isosteric_A_C220S/PVA _/S267K/L368D/K370S_(GGGGS)2_IL15Ralpha(Sushi) _IL15(single-chain)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 267 - protein, 231 aa, Artificial Sequence; identical to SEQ ID NO: 64
  Description of Artificial Sequence: Synthetic polypeptide
  Fc chain of Chain 1 - empty-Fc(216)_IgG1_pI(-)_Isosteric_A _C220S/PVA_/S267K/L368D/K370S_(GGGGS)2_IL15Ralpha(Sushi) _IL15(single-chain)

SEQ ID NO: 268 - protein, 65 aa, Artificial Sequence; identical to SEQ ID NO: 4
  Description of Artificial Sequence: Synthetic polypeptide
  Chain 1 - empty-Fc(216)_IgG1_pI(-)_Isosteric_A_C220S/PVA _/S267K/L368D/K370S_(GGGGS)2_IL15Ralpha(Sushi) _IL15(single-chain) IL15Ralpha(Sushi)

SEQ ID NO: 269 - protein, 114 aa, Artificial Sequence; identical to SEQ ID NO: 2
  Description of Artificial Sequence: Synthetic polypeptide
  Chain 1 - empty-Fc(216)_IgG1_pI(-)_Isosteric_A_C220S/PVA _/S267K/L368D/K370S_(GGGGS)2_IL15Ralpha(Sushi) _IL15(single-chain) IL15

SEQ ID NO: 270 - protein, 231 aa, Artificial Sequence; identical to SEQ ID NO: 88
  Description of Artificial Sequence: Synthetic polypeptide
  Chain 2 - empty-Fc(216)_IgG1_ISO(+RR)_C220S/PVA _/S267K/S364K/E357Q (8927)

SEQ ID NO: 271 - protein, 66 aa, Artificial Sequence
  Description of Artificial Sequence: Synthetic polypeptide
  IL-15Ralpha(sushi-D96)
ITCPPPMSVEHADIWVKSYSLYSRERYICNSGFKRKAGTSSLTECVLNKATNVAHWTTPSLKCIRD

SEQ ID NO: 272 - protein, 67 aa, Artificial Sequence
  Description of Artificial Sequence: Synthetic polypeptide
  IL-15Ralpha(sushi-D96/P97)
ITCPPPMSVEHADIWVKSYSLYSRERYICNSGFKRKAGTSSLTECVLNKATNVAHWTTPSLKCIRDP

SEQ ID NO: 273 - protein, 68 aa, Artificial Sequence
  Description of Artificial Sequence: Synthetic polypeptide
  IL-15Ralpha(sushi-D96/P97/A98)
ITCPPPMSVEHADIWVKSYSLYSRERYICNSGFKRKAGTSSLTECVLNKATNVAHWTTPSLKCIRDPA

SEQ ID NO: 274 - protein, 114 aa, Artificial Sequence
  Description of Artificial Sequence: Synthetic polypeptide
  IL-15(E87C)
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTS

SEQ ID NO: 275 - protein, 114 aa, Artificial Sequence
  Description of Artificial Sequence: Synthetic polypeptide
  IL-15(V49C)
NWVNVISDLKKIEDLIQSMHIDATLYTESDVHPSCKVTAMKCFLLELQCISLESGDASIHDTVENLIILANNSLSSNGNVTESGCKECEELEEKNIKEFLQSFVHIVQMFINTS

SEQ ID NO: 276 - protein, 114 aa, Artificial Sequence
  Description of Artificial Sequence: Synthetic polypeptide
  IL-15(L52C)
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTS

SEQ ID NO: 277 - protein, 114 aa, Artificial Sequence
  Description of Artificial Sequence: Synthetic polypeptide
  IL-15(E89C)
NWVNVISDLKKIEDLIQSMHIDATLYTESDVHPSCKVTAMKCFLLELQVISLESGDASIHDTVENLIILANNSLSSNGNVTESGCKECCELEEKNIKEFLQSFVHIVQMFINTS

SEQ ID NO: 278 - protein, 114 aa, Artificial Sequence
  Description of Artificial Sequence: Synthetic polypeptide
  IL-15(Q48C)
NWVNVISDLKKIEDLIQSMHIDATLYTESDVHPSCKVTAMKCFLLELCVISLESGDASIHDTVENLIILANNSLSSNGNVTESGCKECEELEEKNIKEFLQSFVHIVQMFINTS

SEQ ID NO: 279 - protein, 114 aa, Artificial Sequence
  Description of Artificial Sequence: Synthetic polypeptide
  IL-15(E53C)
NWVNVISDLKKIEDLIQSMHIDATLYTESDVHPSCKVTAMKCFLLELQVISLCSGDASIHDTVENLIILANNSLSSNGNVTESGCKECEELEEKNIKEFLQSFVHIVQMFINTS

SEQ ID NO: 280 - protein, 114 aa, Artificial Sequence
  Description of Artificial Sequence: Synthetic polypeptide
  IL-15(C42S)
NWVNVISDLKKIEDLIQSMHIDATLYTESDVHPSCKVTAMKSFLLELQVISLESGDASIHDTVENLIILANNSLSSNGNVTESGCKECEELEEKNIKEFLQSFVHIVQMFINTS

SEQ ID NO: 281 - protein, 114 aa, Artificial Sequence
  Description of Artificial Sequence: Synthetic polypeptide
  IL-15(L45C)
NWVNVISDLKKIEDLIQSMHIDATLYTESDVHPSCKVTAMKCFLCELQVISLESGDASIHDTVENLIILANNSLSSNGNVTESGCKECEELEEKNIKEFLQSFVHIVQMFINTS

SEQ ID NO: 282 - protein, 67 aa, Artificial Sequence
  Description of Artificial Sequence: Synthetic polypeptide
  IL-15Ralpha(sushi-D96/C97)
ITCPPPMSVEHADIWVKSYSLYSRERYICNSGFKRKAGTSSLTECVLNKATNVAHWTTPSLKCIRDC

SEQ ID NO: 283 - protein, 68 aa, Artificial Sequence
  Description of Artificial Sequence: Synthetic polypeptide
  IL-15Ralpha(sushi-D96/P97/C98)
ITCPPPMSVEHADIWVKSYSLYSRERYICNSGFKRKAGTSSLTECVLNKATNVAHWTTPSLKCIRDPC

SEQ ID NO: 284 - protein, 68 aa, Artificial Sequence
  Description of Artificial Sequence: Synthetic polypeptide
  IL-15Ralpha(sushi-D96/C97/A98)
ITCPPPMSVEHADIWVKSYSLYSRERYICNSGFKRKAGTSSLTECVLNKATNVAHWTTPSLKCIRDCA

SEQ ID NO: 285 - protein, 65 aa, Artificial Sequence
  Description of Artificial Sequence: Synthetic polypeptide
  IL-15Ralpha(sushi-S40C)
ITCPPPMSVEHADIWVKSYSLYSRERYICNSGFKRKAGTCSLTECVLNKATNVAHWTTPSLKCIR

SEQ ID NO: 286 - protein, 65 aa, Artificial Sequence
  Description of Artificial Sequence: Synthetic polypeptide
  IL-15Ralpha(sushi-K34C)
ITCPPPMSVEHADIWVKSYSLYSRERYICNSGFCRKAGTSSLTECVLNKATNVAHWTTPSLKCIR

SEQ ID NO: 287 - protein, 65 aa, Artificial Sequence
  Description of Artificial Sequence: Synthetic polypeptide
  IL-15Ralpha(sushi-G38C)
ITCPPPMSVEHADIWVKSYSLYSRERYICNSGFKRKACTSSLTECVLNKATNVAHWTTPSLKCIR

SEQ ID NO: 288 - protein, 65 aa, Artificial Sequence
  Description of Artificial Sequence: Synthetic polypeptide
  IL-15Ralpha(sushi-L42C)
ITCPPPMSVEHADIWVKSYSLYSRERYICNSGFKRKAGTSSCTECVLNKATNVAHWTTPSLKCIR

SEQ ID NO: 289 - protein, 65 aa, Artificial Sequence
  Description of Artificial Sequence: Synthetic polypeptide
  IL-15Ralpha(sushi-A37C)
ITCPPPMSVEHADIWVKSYSLYSRERYICNSGFKRKCGTSSLTECVLNKATNVAHWTTPSLKCIR

SEQ ID NO: 290 - protein, 350 aa, Artificial Sequence
  Description of Artificial Sequence: Synthetic polypeptide
  XENP022013 Chain 1 - human_IL15_E87C_(GGGGS)1_Fc(216)_IgG1 _pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 291 - protein, 114 aa, Artificial Sequence; identical to SEQ ID NO: 274
  Description of Artificial Sequence: Synthetic polypeptide
  XENP022013 human IL15

SEQ ID NO: 292 - protein, 231 aa, Artificial Sequence; identical to SEQ ID NO: 64
  Description of Artificial Sequence: Synthetic polypeptide
  Fc chain of XENP022013

SEQ ID NO: 293 - protein, 303 aa, Artificial Sequence
  Description of Artificial Sequence: Synthetic polypeptide
  XENP022013 Chain 2 - human_IL15Ralpha(Sushi-D96/C97)_(GGGGS)1 _Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 67 aa, Artificial Sequence; identical to SEQ ID NO: 282
  Description of Artificial Sequence: Synthetic polypeptide
  XENP022013 human IL15Ralpha

SEQ ID NO: 295 - protein, 231 aa, Artificial Sequence; identical to SEQ ID NO: 63
  Description of Artificial Sequence: Synthetic polypeptide
  Fc chain of XENP022013

SEQ ID NO: 296 - protein, 350 aa, Artificial Sequence; identical to SEQ ID NO: 290
  Description of Artificial Sequence: Synthetic polypeptide
  XENP022014 Chain 1 - human_IL15_E87C_(GGGGS)1_Fc(216)_IgG1 _pI(-)_Isosteric_A_C220S/PVA_/S267K/L368D/K370S

SEQ ID NO: 297 - protein, 114 aa, Artificial Sequence; identical to SEQ ID NO: 274
  Description of Artificial Sequence: Synthetic polypeptide
  XENP022014 human IL15

SEQ ID NO: 298 - protein, 231 aa, Artificial Sequence; identical to SEQ ID NO: 64
  Description of Artificial Sequence: Synthetic polypeptide
  Fc chain of XENP022014

SEQ ID NO: 299 - protein, 304 aa, Artificial Sequence
  Description of Artificial Sequence: Synthetic polypeptide
  XENP022014 Chain 2 - human_IL15Ralpha(Sushi-D96/P97/C98) _(GGGGS)1_Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDPCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 68 aa, Artificial Sequence; identical to SEQ ID NO: 283
  Description of Artificial Sequence: Synthetic polypeptide
  XENP022014 human IL15Ralpha

SEQ ID NO: 301 - protein, 231 aa, Artificial Sequence; identical to SEQ ID NO: 63
  Description of Artificial Sequence: Synthetic polypeptide
  Fc chain of XENP022014

SEQ ID NO: 302 - protein, 350 aa, Artificial Sequence; identical to SEQ ID NO: 290
  Description of Artificial Sequence: Synthetic polypeptide
  XENP022015 Chain 1 - human_IL15_E87C_(GGGGS)1_Fc(216)_IgG1 _pI(-)_Isosteric_A_C220S/PVA_/S267K/L368D/K370S

SEQ ID NO: 303 - protein, 114 aa, Artificial Sequence; identical to SEQ ID NO: 274
  Description of Artificial Sequence: Synthetic polypeptide
  XENP022015 human IL15

SEQ ID NO: 304 - protein, 231 aa, Artificial Sequence; identical to SEQ ID NO: 64
  Description of Artificial Sequence: Synthetic polypeptide
  Fc chain of XENP022015

SEQ ID NO: 305 - protein, 304 aa, Artificial Sequence
  Description of Artificial Sequence: Synthetic polypeptide
  XENP022015 Chain 2 - human_IL15Ralpha(Sushi-D96/C97/A98) _(GGGGS)1_Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDCAGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 68 aa, Artificial Sequence; identical to SEQ ID NO: 284
  Description of Artificial Sequence: Synthetic polypeptide
  XENP022015 human IL15Ralpha

SEQ ID NO: 307 - protein, 231 aa, Artificial Sequence; identical to SEQ ID NO: 63
  Description of Artificial Sequence: Synthetic polypeptide
  Fc chain of XENP022015

SEQ ID NO: 308 - protein, 350 aa, Artificial Sequence
  Description of Artificial Sequence: Synthetic polypeptide
  XENP022017 Chain 1 - human_IL15_L52C_(GGGGS)1-_Fc(216)_IgG1 _pI(-)_Isosteric_A_C220S/PVA_/S267K/L368D/K370S
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 309 - protein, 114 aa, Artificial Sequence; identical to SEQ ID NO: 276
  Description of Artificial Sequence: Synthetic polypeptide
  XENP022017 human IL15

SEQ ID NO: 310 - protein, 231 aa, Artificial Sequence; identical to SEQ ID NO: 64
  Description of Artificial Sequence: Synthetic polypeptide
  Fc chain of XENP022017

SEQ ID NO: 311 - protein, 301 aa, Artificial Sequence
  Description of Artificial Sequence: Synthetic polypeptide
  XENP022017 Chain 2 - human_IL15Ralpha(Sushi-S40C)_(GGGGS)1 _Fc(216)_IgG1_C220S/PVA_/S267K/S364K/E357Q
ITCPPPMSVEHADIWVKSYSLYSRERYICNSGFKRKAGTCSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 65 aa, Artificial Sequence; identical to SEQ ID NO: 285
  Description of Artificial Sequence: Synthetic polypeptide
  XENP022017 human IL15Ralpha

SEQ ID NO: 313 - protein, 231 aa, Artificial Sequence; identical to SEQ ID NO: 63
  Description of Artificial Sequence: Synthetic polypeptide
  Fc chain of XENP022017

SEQ ID NO: 314 - protein, 114 aa, Artificial Sequence; identical to SEQ ID NO: 274
  Description of Artificial Sequence: Synthetic polypeptide
  XENP022358 Chain 1 - human_IL15_E87C_no_tag (17074)

SEQ ID NO: 315 - protein, 231 aa, Artificial Sequence; identical to SEQ ID NO: 64
  Description of Artificial Sequence: Synthetic polypeptide
  XENP022358 Chain 2 - empty-Fc(216)_IgG1_pI(-)_Isosteric_A _C220S/PVA_/S267K/L368D/K370S (8793)

SEQ ID NO: 316 - protein, 304 aa, Artificial Sequence; identical to SEQ ID NO: 299
  Description of Artificial Sequence: Synthetic polypeptide
  XENP022358 Chain 3 - human_IL15Ralpha(Sushi-D96/P97/C98) _(GGGGS)1_Fc(216)_IgG1_C220S/PVA_/S267K/S364K/E357Q (17039)

SEQ ID NO: 317 - protein, 68 aa, Artificial Sequence; identical to SEQ ID NO: 283
  Description of Artificial Sequence: Synthetic polypeptide
  XENP022358 human IL15Ralpha

SEQ ID NO: 318 - protein, 231 aa, Artificial Sequence; identical to SEQ ID NO: 63
  Description of Artificial Sequence: Synthetic polypeptide
  Fc chain of XENP022358

SEQ ID NO: 319 - protein, 114 aa, Artificial Sequence; identical to SEQ ID NO: 274
  Description of Artificial Sequence: Synthetic polypeptide
  XENP022359 Chain 1 - human_IL15_E87C_no_tag (17074)

SEQ ID NO: 320 - protein, 231 aa, Artificial Sequence; identical to SEQ ID NO: 64
  Description of Artificial Sequence: Synthetic polypeptide
  XENP022359 Chain 2 - empty-Fc(216)_IgG1_pI(-)_Isosteric_A _C220S/PVA_/S267K/L368D/K370S (8793)

SEQ ID NO: 321 - protein, 304 aa, Artificial Sequence; identical to SEQ ID NO: 305
  Description of Artificial Sequence: Synthetic polypeptide
  XENP022359 Chain 3 - human_IL15Ralpha(Sushi-D96/C97/A98) _(GGGGS)1_Fc(216)_IgG1_C220S/PVA_/S267K/S364K/E357Q (17040)

SEQ ID NO: 322 - protein, 68 aa, Artificial Sequence; identical to SEQ ID NO: 284
  Description of Artificial Sequence: Synthetic polypeptide
  XENP022359 human IL15Ralpha

SEQ ID NO: 323 - protein, 231 aa, Artificial Sequence; identical to SEQ ID NO: 63
  Description of Artificial Sequence: Synthetic polypeptide
  Fc chain of XENP022359

SEQ ID NO: 324 - protein, 114 aa, Artificial Sequence; identical to SEQ ID NO: 276
  Description of Artificial Sequence: Synthetic polypeptide
  XENP022361 Chain 1 - human_IL15_L52C_no_tag (17072)

SEQ ID NO: 325 - protein, 231 aa, Artificial Sequence; identical to SEQ ID NO: 64
  Description of Artificial Sequence: Synthetic polypeptide
  XENP022361 Chain 2 - empty-Fc(216)_IgG1_pI(-)_Isosteric_A _C220S/PVA_/S267K/L368D/K370S (8793)

SEQ ID NO: 326 - protein, 301 aa, Artificial Sequence; identical to SEQ ID NO: 311
  Description of Artificial Sequence: Synthetic polypeptide
  XENP022361 Chain 3 - human_IL15Ralpha(Sushi-S40C)_(GGGGS)1 _Fc(216)_IgG1_C220S/PVA_/S267K/S364K/E357Q (17044)

SEQ ID NO: 327 - protein, 65 aa, Artificial Sequence; identical to SEQ ID NO: 285
  Description of Artificial Sequence: Synthetic polypeptide
  XENP022361 human IL15Ralpha

SEQ ID NO: 328 - protein, 231 aa, Artificial Sequence; identical to SEQ ID NO: 63
  Description of Artificial Sequence: Synthetic polypeptide
  Fc chain of XENP022361

SEQ ID NO: 329 - protein, 114 aa, Artificial Sequence; identical to SEQ ID NO: 274
  Description of Artificial Sequence: Synthetic polypeptide
  XENP022684 Chain 1 - IL15_E87C

SEQ ID NO: 330 - protein, 299 aa, Artificial Sequence
  Description of Artificial Sequence: Synthetic polypeptide
  XENP022684 Chain 2 - IL15Ralpha(Sushi-D96/C97/A98)_Fc(216) _IgG1_pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 68 aa, Artificial Sequence; identical to SEQ ID NO: 284
  Description of Artificial Sequence: Synthetic polypeptide
  XENP022684 human IL15Ralpha

SEQ ID NO: 332 - protein, 231 aa, Artificial Sequence; identical to SEQ ID NO: 63
  Description of Artificial Sequence: Synthetic polypeptide
  Fc chain of XENP022684

SEQ ID NO: 333 - protein, 298 aa, Artificial Sequence
  Description of Artificial Sequence: Synthetic polypeptide
  XENP022634 Chain 1 - human_IL15Ralpha(Sushi-D96/C97)-Fc(216) _IgG1_C220S/PVA_/S267K (17581)
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 334 - protein, 67 aa, Artificial Sequence; identical to SEQ ID NO: 282
  Description of Artificial Sequence: Synthetic polypeptide
  XENP022634 human IL15Ralpha

SEQ ID NO: 335 - protein, 231 aa, Artificial Sequence; identical to SEQ ID NO: 85
  Description of Artificial Sequence: Synthetic polypeptide
  Fc chain of XENP022634

SEQ ID NO: 336 - protein, 114 aa, Artificial Sequence; identical to SEQ ID NO: 274
  Description of Artificial Sequence: Synthetic polypeptide
  XENP022634 Chain 2 - human_IL15_E87C_no_tag (17074)

SEQ ID NO: 337 - protein, 299 aa, Artificial Sequence
  Description of Artificial Sequence: Synthetic polypeptide
  XENP022635 Chain 1 - human_IL15Ralpha(Sushi-D96/C97/A98) -Fc(216)_IgG1_C220S/PVA_/S267K (17582)
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 338 - protein, 68 aa, Artificial Sequence; identical to SEQ ID NO: 284
  Description of Artificial Sequence: Synthetic polypeptide
  XENP022635 human IL15Ralpha

SEQ ID NO: 339 - protein, 231 aa, Artificial Sequence; identical to SEQ ID NO: 85
  Description of Artificial Sequence: Synthetic polypeptide
  Fc chain of XENP022635

SEQ ID NO: 340 - protein, 114 aa, Artificial Sequence; identical to SEQ ID NO: 274
  Description of Artificial Sequence: Synthetic polypeptide
  XENP022635 Chain 2 - human_IL15_E87C_no_tag (17074)

SEQ ID NO: 341 - protein, 296 aa, Artificial Sequence
  Description of Artificial Sequence: Synthetic polypeptide
  XENP022636 Chain 1 - human_IL15Ralpha(Sushi-S40C)-Fc(216)_IgG1 _C220S/PVA_/S267K (17583)
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 342 - protein, 65 aa, Artificial Sequence; identical to SEQ ID NO: 285
  Description of Artificial Sequence: Synthetic polypeptide
  XENP022636 human IL15Ralpha

SEQ ID NO: 343 - protein, 231 aa, Artificial Sequence; identical to SEQ ID NO: 85
  Description of Artificial Sequence: Synthetic polypeptide
  Fc chain of XENP022636

SEQ ID NO: 344 - protein, 114 aa, Artificial Sequence; identical to SEQ ID NO: 276
  Description of Artificial Sequence: Synthetic polypeptide
  XENP022636 Chain 2 - human_IL15_L52C_no_tag (17072)

SEQ ID NO: 345 - protein, 308 aa, Artificial Sequence
  Description of Artificial Sequence: Synthetic polypeptide
  XENP022639 Chain 1 - empty-Fc(216)_IgG1_pI(-)_Isosteric_A _C220S/PVA_/S267K/L368D/K370S_(GGGGS)2 _IL15Ralpha(Sushi-D96/C97) (17605)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 346 - protein, 231 aa, Artificial Sequence; identical to SEQ ID NO: 64
  Description of Artificial Sequence: Synthetic polypeptide
  Fc chain of XENP022639

SEQ ID NO: 347 - protein, 67 aa, Artificial Sequence; identical to SEQ ID NO: 282
  Description of Artificial Sequence: Synthetic polypeptide
  XENP022639 IL15Ralpha(Sushi)

SEQ ID NO: 348 - protein, 231 aa, Artificial Sequence; identical to SEQ ID NO: 88
  Description of Artificial Sequence: Synthetic polypeptide
  XENP022639 Chain 2 - empty-Fc(216)_IgG1_ISO(+RR)_C220S/PVA _/S267K/S364K/E357Q (8927)

SEQ ID NO: 349 - protein, 114 aa, Artificial Sequence; identical to SEQ ID NO: 274
  Description of Artificial Sequence: Synthetic polypeptide
  XENP022639 Chain 3 - human_IL15_E87C_no_tag (17074)

SEQ ID NO: 350 - protein, 114 aa, Artificial Sequence; identical to SEQ ID NO: 274
  Description of Artificial Sequence: Synthetic polypeptide
  XENP022640 Chain 1 - IL15

SEQ ID NO: 351 - protein, 231 aa, Artificial Sequence; identical to SEQ ID NO: 64
  Description of Artificial Sequence: Synthetic polypeptide
  XENP022640 Chain 2 - empty_Fc(216)_IgG1_pI(-)_Isosteric_A _C220S/PVA_/S267K/L368D/K370S

SEQ ID NO: 352 - protein, 114 aa, Artificial Sequence
  Description of Artificial Sequence: Synthetic polypeptide
  N1D
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 353 - protein, 114 aa, Artificial Sequence
  Description of Artificial Sequence: Synthetic polypeptide
  N4D
NWVDVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 354 - protein, 114 aa, Artificial Sequence
  Description of Artificial Sequence: Synthetic polypeptide
  D8N
NWVNVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 355 - protein, 114 aa, Artificial Sequence
  Description of Artificial Sequence: Synthetic polypeptide
  D30N
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 356 - protein, 114 aa, Artificial Sequence
  Description of Artificial Sequence: Synthetic polypeptide
  D61N
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 357 - protein, 114 aa, Artificial Sequence
  Description of Artificial Sequence: Synthetic polypeptide
  E64Q
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 358 - protein, 114 aa, Artificial Sequence
  Description of Artificial Sequence: Synthetic polypeptide
  N65D
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 359 - protein, 114 aa, Artificial Sequence
  Description of Artificial Sequence: Synthetic polypeptide
  Q108E
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 360 - protein, 114 aa, Artificial Sequence
  Description of Artificial Sequence: Synthetic polypeptide
  N1D/D61N
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 361 - protein, 114 aa, Artificial Sequence
  Description of Artificial Sequence: Synthetic polypeptide
  N1D/E64Q
DWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 362 - protein, 114 aa, Artificial Sequence
  Description of Artificial Sequence: Synthetic polypeptide
  N4D/D61N
NWVDVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 363 - protein, 114 aa, Artificial Sequence
  Description of Artificial Sequence: Synthetic polypeptide
  N4D/E64Q
NWVDVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 364 - protein, 114 aa, Artificial Sequence
  Description of Artificial Sequence: Synthetic polypeptide
  D8N/D61N
NWVNVISNLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 365 - protein, 114 aa, Artificial Sequence
  Description of Artificial Sequence: Synthetic polypeptide
  D8N/E64Q
NWVNVISNLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 366 - protein, 114 aa, Artificial Sequence
  Description of Artificial Sequence: Synthetic polypeptide
  D61N/E64Q
NWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVQMFINTS

SEQ ID NO: 367 - protein, 114 aa, Artificial Sequence
  Description of Artificial Sequence: Synthetic polypeptide
  E64Q/Q108E
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVEMFINTS

SEQ ID NO: 368 - protein, 114 aa, Artificial Sequence
  Description of Artificial Sequence: Synthetic polypeptide
  N1D/N4D/D8N
DWVDVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 369 - protein, 114 aa, Artificial Sequence
  Description of Artificial Sequence: Synthetic polypeptide
  D61N/E64Q/N65D
NWVNVISDLKKIEDLIQSMHIDATLYTESDVHPSCKVTAMKCFLLELQVISLESGDASIHNTVQDLIILANNSLSSNGNVTESGCKECEELEEKNIKEFLQSFVHIVQMFINTS

SEQ ID NO: 370 - protein, 114 aa, Artificial Sequence
  Description of Artificial Sequence: Synthetic polypeptide
  N1D/D61N/E64Q/Q108E
DWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 371 - protein, 114 aa, Artificial Sequence
  Description of Artificial Sequence: Synthetic polypeptide
  N4D/D61N/E64Q/Q108E
NWVDVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 372 - protein, 114 aa, Artificial Sequence
  Description of Artificial Sequence: Synthetic polypeptide
  N1D/N65D
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 373 - protein, 114 aa, Artificial Sequence
  Description of Artificial Sequence: Synthetic polypeptide
  N1D/Q108E
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 374 - protein, 114 aa, Artificial Sequence
  Description of Artificial Sequence: Synthetic polypeptide
  N4D/N65D
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 375 - protein, 114 aa, Artificial Sequence
  Description of Artificial Sequence: Synthetic polypeptide
  D30N/N65D
NWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTS

SEQ ID NO: 376 - protein, 114 aa, Artificial Sequence
  Description of Artificial Sequence: Synthetic polypeptide
  D30N/Q108E
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVEMFINTS

SEQ ID NO: 377 - protein, 114 aa, Artificial Sequence
  Description of Artificial Sequence: Synthetic polypeptide
  N65D/Q108E
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTS

SEQ ID NO: 378 - protein, 114 aa, Artificial Sequence
  Description of Artificial Sequence: Synthetic polypeptide
  E64Q/N65D
NWVNVISDLKKIEDLIQSMHIDATLYTESDVHPSCKVTAMKCFLLELQVISLESGDASIHDTVQDLIILANNSLSSNGNVTESGCKECEELEEKNIKEFLQSFVHIVQMFINTS

SEQ ID NO: 379 - protein, 114 aa, Artificial Sequence
  Description of Artificial Sequence: Synthetic polypeptide
  N1D/N4D/N65D
DWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 380 - protein, 114 aa, Artificial Sequence
  Description of Artificial Sequence: Synthetic polypeptide
  D30N/E64Q/N65D
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTS

SEQ ID NO: 381 - protein, 114 aa, Artificial Sequence
  Description of Artificial Sequence: Synthetic polypeptide
  N4D/D61N/N65D
NWVDVISDLKKIEDLIQSMHIDATLYTESDVHPSCKVTAMKCFLLELQVISLESGDASIHNTVEDLIILANNSLSSNGNVTESGCKECEELEEKNIKEFLQSFVHIVQMFINTS

SEQ ID NO: 382 - protein, 350 aa, Artificial Sequence
  Description of Artificial Sequence: Synthetic polypeptide
  XENP022821 Chain 1 - human_IL15_N65D_(GGGGS)1 (17692)
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 383 - protein, 114 aa, Artificial Sequence; identical to SEQ ID NO: 358
  Description of Artificial Sequence: Synthetic polypeptide
  XENP022821 human IL15

SEQ ID NO: 384 - protein, 231 aa, Artificial Sequence; identical to SEQ ID NO: 64
  Description of Artificial Sequence: Synthetic polypeptide
  Fc chain of XENP022821

SEQ ID NO: 385 - protein, 301 aa, Artificial Sequence; identical to SEQ ID NO: 224
  Description of Artificial Sequence: Synthetic polypeptide
  XENP022821 Chain 2 - human_IL15Ralpha(Sushi)_(GGGGS)1_Fc(216) _IgG1_pI(-)_Isosteric_A_C220S/PVA_/S267K/L368D/K370S -Fc(216)_IgG1_C220S/PVA_/S267K/S364K/E357Q (15908)

SEQ ID NO: 386 - protein, 65 aa, Artificial Sequence; identical to SEQ ID NO: 4
  Description of Artificial Sequence: Synthetic polypeptide
  XENP022821 human IL15Ralpha(Sushi)

SEQ ID NO: 387 - protein, 231 aa, Artificial Sequence; identical to SEQ ID NO: 63
  Description of Artificial Sequence: Synthetic polypeptide
  Fc chain of XENP022821

SEQ ID NO: 388 - protein, 350 aa, Artificial Sequence
  Description of Artificial Sequence: Synthetic polypeptide
  XENP022822 Chain 1 - human_IL15_Q108E_(GGGGS)1 (17693)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 389 - protein, 114 aa, Artificial Sequence; identical to SEQ ID NO: 359
  Description of Artificial Sequence: Synthetic polypeptide
  XENP022822 human IL15

SEQ ID NO: 390 - protein, 231 aa, Artificial Sequence; identical to SEQ ID NO: 64
  Description of Artificial Sequence: Synthetic polypeptide
  Fc chain of XENP022822

SEQ ID NO: 391 - protein, 301 aa, Artificial Sequence; identical to SEQ ID NO: 224
  Description of Artificial Sequence: Synthetic polypeptide
  XENP022822 Chain 2 - human_IL15Ralpha(Sushi)_(GGGGS)1_Fc(216) _IgG1_pI(-)_Isosteric_A_C220S/PVA_/S267K/L368D/K370S -Fc(216)_IgG1_C220S/PVA_/S267K/S364K/E357Q (15908)

SEQ ID NO: 392 - protein, 65 aa, Artificial Sequence; identical to SEQ ID NO: 4
  Description of Artificial Sequence: Synthetic polypeptide
  XENP022822 human IL15Ralpha(Sushi)

SEQ ID NO: 393 - protein, 231 aa, Artificial Sequence; identical to SEQ ID NO: 63
  Description of Artificial Sequence: Synthetic polypeptide
  Fc chain of XENP022822

SEQ ID NO: 394 - protein, 350 aa, Artificial Sequence
  Description of Artificial Sequence: Synthetic polypeptide
  XENP023554 Chain 1 - human_IL15_N1D/N65D_(GGGGS)1_Fc(216)_IgG1 _pI(-)_Isosteric_A_C220S/PVA_/S267K/L368D/K370S (18783)
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 395 - protein, 114 aa, Artificial Sequence; identical to SEQ ID NO: 372
  Description of Artificial Sequence: Synthetic polypeptide
  XENP023554 human IL15

SEQ ID NO: 396 - protein, 231 aa, Artificial Sequence; identical to SEQ ID NO: 64
  Description of Artificial Sequence: Synthetic polypeptide
  Fc chain of XENP023554

SEQ ID NO: 397 - protein, 301 aa, Artificial Sequence; identical to SEQ ID NO: 224
  Description of Artificial Sequence: Synthetic polypeptide
  XENP023554 Chain 2 - human_IL15Ralpha(Sushi)_(GGGGS)1_Fc(216) _IgG1_C220S/PVA_/S267K/S364K/E357Q (15908)

SEQ ID NO: 398 - protein, 65 aa, Artificial Sequence; identical to SEQ ID NO: 4
  Description of Artificial Sequence: Synthetic polypeptide
  XENP023554 human IL15Ralpha(Sushi)

SEQ ID NO: 399 - protein, 231 aa, Artificial Sequence; identical to SEQ ID NO: 63
  Description of Artificial Sequence: Synthetic polypeptide
  Fc chain of XENP023554

SEQ ID NO: 400 - protein, 350 aa, Artificial Sequence
  Description of Artificial Sequence: Synthetic polypeptide
  XENP023557 Chain 1 - human_IL15_N4D/N65D_(GGGGS)1_Fc(216)_IgG1 _pI(-)_Isosteric_A_C220S/PVA_/S267K/L368D/K370S (18786)
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 401 - protein, 114 aa, Artificial Sequence; identical to SEQ ID NO: 374
  Description of Artificial Sequence: Synthetic polypeptide
  XENP023557 human IL15

SEQ ID NO: 402 - protein, 231 aa, Artificial Sequence; identical to SEQ ID NO: 64
  Description of Artificial Sequence: Synthetic polypeptide
  Fc chain of XENP023557

SEQ ID NO: 403 - protein, 301 aa, Artificial Sequence; identical to SEQ ID NO: 224
  Description of Artificial Sequence: Synthetic polypeptide
  XENP023557 Chain 2 - human_IL15Ralpha(Sushi)_(GGGGS)1_Fc(216) _IgG1_C220S/PVA_/S267K/S364K/E357Q (15908)

SEQ ID NO: 404 - protein, 65 aa, Artificial Sequence; identical to SEQ ID NO: 4
  Description of Artificial Sequence: Synthetic polypeptide
  XENP023557 human IL15Ralpha(Sushi)

SEQ ID NO: 405 - protein, 231 aa, Artificial Sequence; identical to SEQ ID NO: 63
  Description of Artificial Sequence: Synthetic polypeptide
  Fc chain of XENP023557

SEQ ID NO: 406 - protein, 350 aa, Artificial Sequence
  Description of Artificial Sequence: Synthetic polypeptide
  XENP023561 Chain 1 - human_IL15_N65D/Q108E_(GGGGS)1_Fc(216) _IgG1_pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 407 - protein, 114 aa, Artificial Sequence; identical to SEQ ID NO: 377
  Description of Artificial Sequence: Synthetic polypeptide
  XENP023561 human IL15

SEQ ID NO: 408 - protein, 231 aa, Artificial Sequence; identical to SEQ ID NO: 64
  Description of Artificial Sequence: Synthetic polypeptide
  Fc chain of XENP023561

SEQ ID NO: 409 - protein, 301 aa, Artificial Sequence; identical to SEQ ID NO: 224
  Description of Artificial Sequence: Synthetic polypeptide
  XENP023561 Chain 2 - human_IL15Ralpha(Sushi)_(GGGGS)1_Fc(216) _IgG1_C220S/PVA_/S267K/S364K/E357Q

SEQ ID NO: 410 - protein, 65 aa, Artificial Sequence; identical to SEQ ID NO: 4
  Description of Artificial Sequence: Synthetic polypeptide
  XENP023561 human IL15Ralpha(Sushi)

SEQ ID NO: 411 - protein, 231 aa, Artificial Sequence; identical to SEQ ID NO: 63
  Description of Artificial Sequence: Synthetic polypeptide
  Fc chain of XENP023561

SEQ ID NO: 412 - protein, 345 aa, Artificial Sequence
  Description of Artificial Sequence: Synthetic polypeptide
  XENP024018 Chain 1 - human_IL15(N65D)_Fc(216)_IgG1_pI(-) _Isosteric_A_C220S/PVA_/S267K/L368D/K370S
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 413 - protein, 114 aa, Artificial Sequence; identical to SEQ ID NO: 358
  Description of Artificial Sequence: Synthetic polypeptide
  XENP024018 human IL15

SEQ ID NO: 414 - protein, 231 aa, Artificial Sequence; identical to SEQ ID NO: 64
  Description of Artificial Sequence: Synthetic polypeptide
  Fc chain of XENP024018

SEQ ID NO: 415 - protein, 296 aa, Artificial Sequence; identical to SEQ ID NO: 230
  Description of Artificial Sequence: Synthetic polypeptide
  XENP024018 Chain 2 - human_IL15Ralpha(Sushi)_Fc(216)_IgG1 _C220S/PVA_/S267K/S364K/E357Q

SEQ ID NO: 416 - protein, 65 aa, Artificial Sequence; identical to SEQ ID NO: 4
  Description of Artificial Sequence: Synthetic polypeptide
  XENP024018 human IL15Ralpha(Sushi)

SEQ ID NO: 417 - protein, 231 aa, Artificial Sequence; identical to SEQ ID NO: 63
  Description of Artificial Sequence: Synthetic polypeptide
  Fc chain of XENP024018

SEQ ID NO: 418 - protein, 345 aa, Artificial Sequence
  Description of Artificial Sequence: Synthetic polypeptide
  XENP024019 Chain 1 - human_IL15(Q108E)-human_IL15Ralpha(Sushi) _Fc(216)_IgG1_pI(-)_Isosteric_A_C220S/PVA _/S267K/L368D/K370S (19242)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 419 - protein, 114 aa, Artificial Sequence; identical to SEQ ID NO: 359
  Description of Artificial Sequence: Synthetic polypeptide
  XENP024019 human IL15

SEQ ID NO: 420 - protein, 231 aa, Artificial Sequence; identical to SEQ ID NO: 64
  Description of Artificial Sequence: Synthetic polypeptide
  Fc chain of XENP024019

SEQ ID NO: 421 - protein, 296 aa, Artificial Sequence; identical to SEQ ID NO: 230
  Description of Artificial Sequence: Synthetic polypeptide
  XENP024019 Chain 2 - human_IL15Ralpha(Sushi)_Fc(216)_IgG1 _C220S/PVA_/S267K/S364K/E357Q (16481)

SEQ ID NO: 422 - protein, 65 aa, Artificial Sequence; identical to SEQ ID NO: 4
  Description of Artificial Sequence: Synthetic polypeptide
  XENP024019 human IL15Ralpha(Sushi)

SEQ ID NO: 423 - protein, 231 aa, Artificial Sequence; identical to SEQ ID NO: 63
  Description of Artificial Sequence: Synthetic polypeptide
  Fc chain of XENP024019

SEQ ID NO: 424 - protein, 350 aa, Artificial Sequence
  Description of Artificial Sequence: Synthetic polypeptide
  XENP024045 Chain 1 - human_IL15_D30N/E64Q/N65D_(GGGGS)1 _Fc(216)_IgG1_pI(-)_Isosteric_A_C220S/PVA_/S267K/L368D/K370S
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 425 - protein, 114 aa, Artificial Sequence; identical to SEQ ID NO: 380
  Description of Artificial Sequence: Synthetic polypeptide
  XENP024045 human IL15

SEQ ID NO: 426 - protein, 231 aa, Artificial Sequence; identical to SEQ ID NO: 64
  Description of Artificial Sequence: Synthetic polypeptide
  Fc chain of XENP024045

SEQ ID NO: 427 - protein, 301 aa, Artificial Sequence; identical to SEQ ID NO: 224
  Description of Artificial Sequence: Synthetic polypeptide
  XENP024045 Chain 2 - human_IL15Ralpha(Sushi)_(GGGGS)1_ Fc(216) _IgG1_C220S/PVA_/S267K/S364K/E357Q

SEQ ID NO: 428 - protein, 65 aa, Artificial Sequence; identical to SEQ ID NO: 4
  Description of Artificial Sequence: Synthetic polypeptide
  XENP024045 human IL15Ralpha(Sushi)

SEQ ID NO: 429 - protein, 231 aa, Artificial Sequence; identical to SEQ ID NO: 63
  Description of Artificial Sequence: Synthetic polypeptide
  Fc chain of XENP024045

SEQ ID NO: 430 - protein, 345 aa, Artificial Sequence
  Description of Artificial Sequence: Synthetic polypeptide
  XENP024051 Chain 1 - human_IL15_N1D/N65D-human_Fc(216)_IgG1 _pI(-)_Isosteric_A_C220S/PVA_/S267K/L368D/K370S
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 431 - protein, 114 aa, Artificial Sequence; identical to SEQ ID NO: 372
  Description of Artificial Sequence: Synthetic polypeptide
  XENP024051 human IL15

SEQ ID NO: 432 - protein, 231 aa, Artificial Sequence; identical to SEQ ID NO: 64
  Description of Artificial Sequence: Synthetic polypeptide
  Fc chain of XENP024051

SEQ ID NO: 433 - protein, 296 aa, Artificial Sequence; identical to SEQ ID NO: 230
  Description of Artificial Sequence: Synthetic polypeptide
  XENP024051 Chain 2 - human_IL15Ralpha(Sushi)_ Fc(216)_IgG1 _C220S/PVA_/S267K/S364K/E357Q

SEQ ID NO: 434 - protein, 65 aa, Artificial Sequence; identical to SEQ ID NO: 4
  Description of Artificial Sequence: Synthetic polypeptide
  XENP024051 human IL15Ralpha(Sushi)

SEQ ID NO: 435 - protein, 231 aa, Artificial Sequence; identical to SEQ ID NO: 63
  Description of Artificial Sequence: Synthetic polypeptide
  Fc chain of XENP024051

SEQ ID NO: 436 - protein, 345 aa, Artificial Sequence
  Description of Artificial Sequence: Synthetic polypeptide
  XENP024052 Chain 1 - human_IL15_N4D/N65D-human_ Fc(216)_IgG1 _pI(-)_Isosteric_A_C220S/PVA_/S267K/L368D/K370S
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 437 - protein, 114 aa, Artificial Sequence; identical to SEQ ID NO: 374
  Description of Artificial Sequence: Synthetic polypeptide
  XENP024052 human IL15

SEQ ID NO: 438 - protein, 231 aa, Artificial Sequence; identical to SEQ ID NO: 64
  Description of Artificial Sequence: Synthetic polypeptide
  Fc chain of XENP024052

SEQ ID NO: 439 - protein, 296 aa, Artificial Sequence; identical to SEQ ID NO: 230
  Description of Artificial Sequence: Synthetic polypeptide
  XENP024052 Chain 2 - human_IL15Ralpha(Sushi)_Fc(216)_IgG1 _C220S/PVA_/S267K/S364K/E357Q

SEQ ID NO: 440 - protein, 65 aa, Artificial Sequence; identical to SEQ ID NO: 4
  Description of Artificial Sequence: Synthetic polypeptide
  XENP024052 human IL15Ralpha(Sushi)

SEQ ID NO: 441 - protein, 231 aa, Artificial Sequence; identical to SEQ ID NO: 63
  Description of Artificial Sequence: Synthetic polypeptide
  Fc chain of XENP024052

SEQ ID NO: 442 - protein, 435 aa, Artificial Sequence
  Description of Artificial Sequence: Synthetic polypeptide
  XENP024015 Chain 1 - human_IL15Ralpha(sushi)_(GGGGS)5-human _IL15(Q108E;single-chain) _Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 443 - protein, 65 aa, Artificial Sequence; identical to SEQ ID NO: 4
  Description of Artificial Sequence: Synthetic polypeptide
  XENP024015 human IL15Ralpha(sushi)

SEQ ID NO: 444 - protein, 114 aa, Artificial Sequence; identical to SEQ ID NO: 359
  Description of Artificial Sequence: Synthetic polypeptide
  XENP024015 human IL15

SEQ ID NO: 445 - protein, 231 aa, Artificial Sequence; identical to SEQ ID NO: 64
  Description of Artificial Sequence: Synthetic polypeptide
  Fc chain of XENP024015

SEQ ID NO: 446 - protein, 231 aa, Artificial Sequence; identical to SEQ ID NO: 63
  Description of Artificial Sequence: Synthetic polypeptide
  XENP024015 Chain 2 - empty_Fc(216)_IgG1_C220S/PVA _/S267K/S364K/E357Q

SEQ ID NO: 447 - protein, 435 aa, Artificial Sequence
  Description of Artificial Sequence: Synthetic polypeptide
  XENP024050 Chain 1 - human_IL15Ralpha(sushi)_(GGGGS)5-human _IL15_N4D/N65D_(single-chain)_Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 448 - protein, 65 aa, Artificial Sequence; identical to SEQ ID NO: 4
  Description of Artificial Sequence: Synthetic polypeptide
  XENP024050 human IL15Ralpha(sushi)

SEQ ID NO: 449 - protein, 114 aa, Artificial Sequence; identical to SEQ ID NO: 374
  Description of Artificial Sequence: Synthetic polypeptide
  XENP024050 human IL15

SEQ ID NO: 450 - protein, 231 aa, Artificial Sequence; identical to SEQ ID NO: 64
  Description of Artificial Sequence: Synthetic polypeptide
  Fc chain of XENP024050

SEQ ID NO: 451 - protein, 231 aa, Artificial Sequence; identical to SEQ ID NO: 63
  Description of Artificial Sequence: Synthetic polypeptide
  XENP024050 Chain 2 - empty_ Fc(216)_IgG1_C220S/PVA _/S267K/S364K/E357Q

SEQ ID NO: 452 - protein, 440 aa, Artificial Sequence
  Description of Artificial Sequence: Synthetic polypeptide
  XENP024475 Chain 1 - human_IL15Ralpha(sushi)_(GGGGS)6-human _IL15(single-chain;Q108E)_Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 453 - protein, 65 aa, Artificial Sequence; identical to SEQ ID NO: 4
  Description of Artificial Sequence: Synthetic polypeptide
  XENP024475 human IL15Ralpha(sushi)

SEQ ID NO: 454 - protein, 114 aa, Artificial Sequence; identical to SEQ ID NO: 359
  Description of Artificial Sequence: Synthetic polypeptide
  XENP024475 human IL15

SEQ ID NO: 455 - protein, 231 aa, Artificial Sequence; identical to SEQ ID NO: 64
  Description of Artificial Sequence: Synthetic polypeptide
  Fc chain of XENP024475

SEQ ID NO: 456 - protein, 231 aa, Artificial Sequence; identical to SEQ ID NO: 63
  Description of Artificial Sequence: Synthetic polypeptide
  XENP024475 Chain 2 - empty_ Fc(216)_IgG1_C220S/PVA _/S267K/S364K/E357Q

SEQ ID NO: 457 - protein, 440 aa, Artificial Sequence
  Description of Artificial Sequence: Synthetic polypeptide
  XENP024476 Chain 1 - human_IL15Ralpha(sushi)_(GGGGS)6-human _IL15(single-chain;N4D/N65D)_Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 458 - protein, 65 aa, Artificial Sequence; identical to SEQ ID NO: 4
  Description of Artificial Sequence: Synthetic polypeptide
  XENP024476 human IL15Ralpha(sushi)

SEQ ID NO: 459 - protein, 114 aa, Artificial Sequence; identical to SEQ ID NO: 374
  Description of Artificial Sequence: Synthetic polypeptide
  XENP024476 human IL15

SEQ ID NO: 460 - protein, 231 aa, Artificial Sequence; identical to SEQ ID NO: 64
  Description of Artificial Sequence: Synthetic polypeptide
  Fc chain of XENP024476

SEQ ID NO: 461 - protein, 231 aa, Artificial Sequence; identical to SEQ ID NO: 63
  Description of Artificial Sequence: Synthetic polypeptide
  XENP024476 Chain 2 - empty_ Fc(216)_IgG1_C220S/PVA _/S267K/S364K/E357Q

SEQ ID NO: 462 - protein, 445 aa, Artificial Sequence
  Description of Artificial Sequence: Synthetic polypeptide
  XENP024478 Chain 1 - human_IL15Ralpha(sushi)_(GGGGS)7-human _IL15(single-chain;Q108E)_Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 463 - protein, 65 aa, Artificial Sequence; identical to SEQ ID NO: 4
  Description of Artificial Sequence: Synthetic polypeptide
  XENP024478 human IL15Ralpha(sushi)

SEQ ID NO: 464 - protein, 114 aa, Artificial Sequence; identical to SEQ ID NO: 359
  Description of Artificial Sequence: Synthetic polypeptide
  XENP024478 human IL15

SEQ ID NO: 465 - protein, 231 aa, Artificial Sequence; identical to SEQ ID NO: 64
  Description of Artificial Sequence: Synthetic polypeptide
  Fc chain of XENP024478

SEQ ID NO: 466 - protein, 231 aa, Artificial Sequence; identical to SEQ ID NO: 63
  Description of Artificial Sequence: Synthetic polypeptide
  XENP024478 Chain 2 - empty_ Fc(216)_IgG1_C220S/PVA _/S267K/S364K/E357Q

SEQ ID NO: 467 - protein, 445 aa, Artificial Sequence
  Description of Artificial Sequence: Synthetic polypeptide
  XENP024479 Chain 1 - human_IL15Ralpha(sushi)_(GGGGS)7-human _IL15(single-chain;N4D/N65D)_Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 468 - protein, 65 aa, Artificial Sequence; identical to SEQ ID NO: 4
  Description of Artificial Sequence: Synthetic polypeptide
  XENP024479 human IL15Ralpha(sushi)

SEQ ID NO: 469 - protein, 114 aa, Artificial Sequence; identical to SEQ ID NO: 374
  Description of Artificial Sequence: Synthetic polypeptide
  XENP024479 human IL15

SEQ ID NO: 470 - protein, 231 aa, Artificial Sequence; identical to SEQ ID NO: 64
  Description of Artificial Sequence: Synthetic polypeptide
  Fc chain of XENP024479

SEQ ID NO: 471 - protein, 231 aa, Artificial Sequence; identical to SEQ ID NO: 63
  Description of Artificial Sequence: Synthetic polypeptide
  XENP024479 Chain 2 - empty-Fc_Fc(216)_IgG1_C220S/PVA _/S267K/S364K/E357Q

SEQ ID NO: 472 - protein, 440 aa, Artificial Sequence
  Description of Artificial Sequence: Synthetic polypeptide
  XENP024481 Chain 1 - human_IL15Ralpha(sushi)_(30AA_linker _variant)-human_IL15(single-chain;Q108E)_Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRDPALVHQRPAPPGGGGSGGGGSGGGGSGGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 473 - protein, 65 aa, Artificial Sequence; identical to SEQ ID NO: 4
  Description of Artificial Sequence: Synthetic polypeptide
  XENP024481 human IL15Ralpha(sushi)

SEQ ID NO: 474 - protein, 114 aa, Artificial Sequence; identical to SEQ ID NO: 359
  Description of Artificial Sequence: Synthetic polypeptide
  XENP024481 human IL15

SEQ ID NO: 475 - protein, 231 aa, Artificial Sequence; identical to SEQ ID NO: 64
  Description of Artificial Sequence: Synthetic polypeptide
  Fc chain of XENP024481

SEQ ID NO: 476 - protein, 231 aa, Artificial Sequence; identical to SEQ ID NO: 63
  Description of Artificial Sequence: Synthetic polypeptide
  XENP024481 Chain 2 - empty_ Fc(216)_IgG1_C220S/PVA _/S267K/S364K/E357Q

SEQ ID NO: 477 - protein, 296 aa, Artificial Sequence; identical to SEQ ID NO: 249
  Description of Artificial Sequence: Synthetic polypeptide
  XENP024349 Chain 1 - human_IL15Ralpha(Sushi)_ Isosteric_A _C220S/PVA_/S267K/L368D/K370S

SEQ ID NO: 478 - protein, 65 aa, Artificial Sequence; identical to SEQ ID NO: 4
  Description of Artificial Sequence: Synthetic polypeptide
  XENP024349 human IL15Ralpha(Sushi)

SEQ ID NO: 479 - protein, 231 aa, Artificial Sequence; identical to SEQ ID NO: 64
  Description of Artificial Sequence: Synthetic polypeptide
  Fc chain of XENP024349

SEQ ID NO: 480 - protein, 231 aa, Artificial Sequence; identical to SEQ ID NO: 63
  Description of Artificial Sequence: Synthetic polypeptide
  XENP024349 Chain 2 - empty- Fc(216)_IgG1_C220S/PVA _/S267K/S364K/E357Q

SEQ ID NO: 481 - protein, 114 aa, Artificial Sequence; identical to SEQ ID NO: 359
  Description of Artificial Sequence: Synthetic polypeptide
  XENP024349 Chain 3 - IL15_Q108E_(non-covalent)

SEQ ID NO: 482 - protein, 296 aa, Artificial Sequence; identical to SEQ ID NO: 249
  Description of Artificial Sequence: Synthetic polypeptide
  XENP024890 Chain 1 - IL-15_N4D/N65D

SEQ ID NO: 483 - protein, 65 aa, Artificial Sequence; identical to SEQ ID NO: 4
  Description of Artificial Sequence: Synthetic polypeptide
  XENP024890 IL-15

SEQ ID NO: 484 - protein, 231 aa, Artificial Sequence; identical to SEQ ID NO: 64
  Description of Artificial Sequence: Synthetic polypeptide
  Fc chain of XENP024890

SEQ ID NO: 485 - protein, 296 aa, Artificial Sequence; identical to SEQ ID NO: 249
  Description of Artificial Sequence: Synthetic polypeptide
  XENP024890 Chain 2 - human_IL15Ralpha(Sushi)_Fc(216)_IgG1 _pI(-)_Isosteric_A_C220S/PVA_/S267K/L368D/K370S

SEQ ID NO: 486 - protein, 65 aa, Artificial Sequence; identical to SEQ ID NO: 4
  Description of Artificial Sequence: Synthetic polypeptide
  XENP024890 human IL15Ralpha(Sushi)

SEQ ID NO: 487 - protein, 231 aa, Artificial Sequence; identical to SEQ ID NO: 64
  Description of Artificial Sequence: Synthetic polypeptide
  Fc chain of XENP024890

SEQ ID NO: 488 - protein, 231 aa, Artificial Sequence; identical to SEQ ID NO: 63
  Description of Artificial Sequence: Synthetic polypeptide
  XENP024890 Chain 3 - empty_Fc(216)_ IgG1_PVA _/S267K/S364K/E357Q

SEQ ID NO: 489 - protein, 114 aa, Artificial Sequence; identical to SEQ ID NO: 380
  Description of Artificial Sequence: Synthetic polypeptide
  XENP25138 Chain 1 - IL15_D30N/E64Q/N65D

SEQ ID NO: 490 - protein, 296 aa, Artificial Sequence; identical to SEQ ID NO: 249
  Description of Artificial Sequence: Synthetic polypeptide
  XENP25138 Chain 2 - human_IL15Ralpha(Sushi)_Fc(216)_IgG1_pI(-) _Isosteric_A_C220S/PVA_/S267K/L368D/K370S

SEQ ID NO: 491 - protein, 65 aa, Artificial Sequence; identical to SEQ ID NO: 4
  Description of Artificial Sequence: Synthetic polypeptide
  XENP25138 human IL15Ralpha(Sushi)

SEQ ID NO: 492 - protein, 231 aa, Artificial Sequence; identical to SEQ ID NO: 64
  Description of Artificial Sequence: Synthetic polypeptide
  Fc chain of XENP25138

SEQ ID NO: 493 - protein, 231 aa, Artificial Sequence; identical to SEQ ID NO: 63
  Description of Artificial Sequence: Synthetic polypeptide
  XENP25138 Chain 3 - empty_Fc(216)_ IgG1_PVA_/S267K/S364K/E357Q

SEQ ID NO: 494 - protein, 114 aa, Artificial Sequence; identical to SEQ ID NO: 358
  Description of Artificial Sequence: Synthetic polypeptide
  XENP022801 Chain 1 - human_IL15_N65D(non-covalent) (17672)

SEQ ID NO: 495 - protein, 65 aa, Artificial Sequence; identical to SEQ ID NO: 4
  Description of Artificial Sequence: Synthetic polypeptide
  XENP022801 Chain 2 - human_IL15Ralpha(Sushi) (17033)

SEQ ID NO: 496 - protein, 114 aa, Artificial Sequence; identical to SEQ ID NO: 359
  Description of Artificial Sequence: Synthetic polypeptide
  XENP022802 Chain 1 - human_IL15_Q108E(non-covalent) (17673)

SEQ ID NO: 497 - protein, 65 aa, Artificial Sequence; identical to SEQ ID NO: 4
  Description of Artificial Sequence: Synthetic polypeptide
  XENP022802 Chain 2 - human_IL15Ralpha(Sushi) (17033)

SEQ ID NO: 498 - protein, 296 aa, Artificial Sequence; identical to SEQ ID NO: 253
  Description of Artificial Sequence: Synthetic polypeptide
  XENP024342 Chain 1 - human_IL15Ralpha(Sushi) _Fc(216)_IgG1 _C220S/PVA_/S267K

SEQ ID NO: 499 - protein, 65 aa, Artificial Sequence; identical to SEQ ID NO: 4
  Description of Artificial Sequence: Synthetic polypeptide
  XENP024342 human IL15Ralpha(Sushi)

SEQ ID NO: 500 - protein, 231 aa, Artificial Sequence; identical to SEQ ID NO: 85
  Description of Artificial Sequence: Synthetic polypeptide
  Fc chain of XENP024342

SEQ ID NO: 501 - protein, 114 aa, Artificial Sequence; identical to SEQ ID NO: 359
  Description of Artificial Sequence: Synthetic polypeptide
  XENP024342 Chain 2 -human_IL15(non-covalent; Q108E)

SEQ ID NO: 502 - protein, 231 aa, Artificial Sequence; identical to SEQ ID NO: 64
  Description of Artificial Sequence: Synthetic polypeptide
  XENP023472 Chain 1 - empty_ Fc(216)_IgG1_pI(-)_Isosteric_A _C220S/PVA_/S267K/L368D/K370S

SEQ ID NO: 503 - protein, 114 aa, Artificial Sequence
  Description of Artificial Sequence: Synthetic polypeptide
  XENP023472 Chain 2 - IL15_N65D/E87C
NWVNVISDLKKIEDLIQSMHIDATLYTESDVHPSCKVTAMKCFLLELQVISLESGDASIHDTVEDLIILANNSLSSNGNVTESGCKCCEELEEKNIKEFLQSFVHIVQMFINTS

SEQ ID NO: 504 - protein, 298 aa, Artificial Sequence
  Description of Artificial Sequence: Synthetic polypeptide
  XENP023472 Chain 3 - IL15Ralpha(Sushi-D96/C97)_Fc(216)_IgG1 _C220S/PVA_/S267K/S364K/E357Q
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 505 - protein, 67 aa, Artificial Sequence; identical to SEQ ID NO: 282
  Description of Artificial Sequence: Synthetic polypeptide
  XENP023472 IL15Ralpha(Sushi)

SEQ ID NO: 506 - protein, 231 aa, Artificial Sequence; identical to SEQ ID NO: 63
  Description of Artificial Sequence: Synthetic polypeptide
  Fc chain of XENP023472

SEQ ID NO: 507 - protein, 231 aa, Artificial Sequence; identical to SEQ ID NO: 64
  Description of Artificial Sequence: Synthetic polypeptide
  XENP023473 Chain 1 - empty_ Fc(216)_IgG1_pI(-)_Isosteric_A _C220S/PVA_/S267K/L368D/K370S

SEQ ID NO: 508 - protein, 114 aa, Artificial Sequence
  Description of Artificial Sequence: Synthetic polypeptide
  XENP023473 Chain 2 - IL15_N65D/L52C
NWVNVISDLKKIEDLIQSMHIDATLYTESDVHPSCKVTAMKCFLLELQVISCESGDASIHDTVEDLIILANNSLSSNGNVTESGCKECEELEEKNIKEFLQSFVHIVQMFINTS

SEQ ID NO: 509 - protein, 296 aa, Artificial Sequence
  Description of Artificial Sequence: Synthetic polypeptide
  XENP023473 Chain 3 - IL15Ralpha(Sushi-S40C)_Fc(216)_IgG1 _C220S/PVA_/S267K/S364K/E357Q
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 65 aa, Artificial Sequence; identical to SEQ ID NO: 285
  Description of Artificial Sequence: Synthetic polypeptide
  XENP023473 IL15Ralpha(Sushi)

SEQ ID NO: 511 - protein, 231 aa, Artificial Sequence; identical to SEQ ID NO: 63
  Description of Artificial Sequence: Synthetic polypeptide
  Fc chain of XENP023473

SEQ ID NO: 512 - protein, 440 aa, Artificial Sequence; identical to SEQ ID NO: 233
  Description of Artificial Sequence: Synthetic polypeptide
  XENP021480 Chain 1 - human_IL15Ralpha(sushi)_(GGGGS)6-human _IL15(single-chain)_IgG1_pI(-)_Isosteric_A_C220S/PVA _/S267K/L368D/K370S

SEQ ID NO: 513 - protein, 65 aa, Artificial Sequence; identical to SEQ ID NO: 4
  Description of Artificial Sequence: Synthetic polypeptide
  XENP021480 human IL15Ralpha(sushi)

SEQ ID NO: 514 - protein, 114 aa, Artificial Sequence; identical to SEQ ID NO: 2
  Description of Artificial Sequence: Synthetic polypeptide
  XENP021480 human IL15

SEQ ID NO: 515 - protein, 231 aa, Artificial Sequence; identical to SEQ ID NO: 64
  Description of Artificial Sequence: Synthetic polypeptide
  Fc chain of XENP021480

SEQ ID NO: 516 - protein, 480 aa, Artificial Sequence
  Description of Artificial Sequence: Synthetic polypeptide
  XENP021480 Chain 2  - 1G6_L1.194_H1.279_scFv(GKPGS)4_IgG1 _C220S/PVA_/S267K/S364K/E357Q
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 517 - protein, 107 aa, Artificial Sequence; identical to SEQ ID NO: 132
  Description of Artificial Sequence: Synthetic polypeptide
  VL of XENP021480

SEQ ID NO: 518 - protein, 122 aa, Artificial Sequence; identical to SEQ ID NO: 127
  Description of Artificial Sequence: Synthetic polypeptide
  VH of XENP021480

SEQ ID NO: 519 - protein, 231 aa, Artificial Sequence; identical to SEQ ID NO: 63
  Description of Artificial Sequence: Synthetic polypeptide
  Fc chain of XENP021480

SEQ ID NO: 520 - protein, 11 aa, Artificial Sequence
  Description of Artificial Sequence: Synthetic peptide
  XENP021480 vlCDR1
RASQSVGNDVA

SEQ ID NO: 521 - protein, 7 aa, Artificial Sequence
  Description of Artificial Sequence: Synthetic peptide
  XENP021480 vlCDR2
YASHRYT

SEQ ID NO: 522 - protein, 9 aa, Artificial Sequence
  Description of Artificial Sequence: Synthetic peptide
  XENP021480 vlCDR3
QQDFSSPRT

SEQ ID NO: 523 - protein, 5 aa, Artificial Sequence
  Description of Artificial Sequence: Synthetic peptide
  XENP021480 vhCDR1
NYWMN

SEQ ID NO: 524 - protein, 19 aa, Artificial Sequence
  Description of Artificial Sequence: Synthetic peptide
  XENP021480 vhCDR2
EIRLYSNNYATHYAESVKG

SEQ ID NO: 525 - protein, 11 aa, Artificial Sequence
  Description of Artificial Sequence: Synthetic peptide
  XENP021480 vhCDR3
YYGNYGGYFDV

SEQ ID NO: 526 - protein, 480 aa, Artificial Sequence
  Description of Artificial Sequence: Synthetic polypeptide
  Chain 1 - 1G6_L1.194_H1.279_scFv(GKPGS)4_ Fc(216)_IgG1_pI(-) _Isosteric_A_C220S/PVA_/S267K/L368D/K370S
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 527 - protein, 107 aa, Artificial Sequence; identical to SEQ ID NO: 132
  Description of Artificial Sequence: Synthetic polypeptide
  VL of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 528 - protein, 122 aa, Artificial Sequence; identical to SEQ ID NO: 127
  Description of Artificial Sequence: Synthetic polypeptide
  VH of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 529 - protein, 231 aa, Artificial Sequence; identical to SEQ ID NO: 64
  Description of Artificial Sequence: Synthetic polypeptide
  Fc chain of Chain 1 - 1G6_L1.194_H1.279_scFv(GKPGS)4_ Fc(216) _IgG1_pI(-)_Isosteric_A_C220S/PVA_/S267K/L368D/K370S

SEQ ID NO: 530 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR1
RASQSVGNDVA

SEQ ID NO: 531 - protein, 7 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR2
YASHRYT

SEQ ID NO: 532 - protein, 9 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR3
QQDFSSPRT

SEQ ID NO: 533 - protein, 5 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR1
NYWMN

SEQ ID NO: 534 - protein, 19 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR2
EIRLYSNNYATHYAESVKG

SEQ ID NO: 535 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR3
YYGNYGGYFDV

SEQ ID NO: 536 - protein, 326 aa, Artificial Sequence
  Description of Artificial Sequence: Synthetic polypeptide
  Chain 2 - human_IL15Ralpha(sushi)_(GGGGS)6_ Fc(216)_IgG1 _C220S/PVA_/S267K/S364K/E357Q
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 537 - protein, 65 aa, Artificial Sequence; identical to SEQ ID NO: 4
  Description of Artificial Sequence: Synthetic polypeptide
  Chain 2 - human_IL15Ralpha(sushi)_(GGGGS)6_ Fc(216)_IgG1 _C220S/PVA_/S267K/S364K/E357Q human IL15Ralpha(sushi)

SEQ ID NO: 538 - protein, 231 aa, Artificial Sequence; identical to SEQ ID NO: 63
  Description of Artificial Sequence: Synthetic polypeptide
  Fc chain of Chain 2 - human_IL15Ralpha(sushi)_(GGGGS)6 _ Fc(216)_IgG1_C220S/PVA_/S267K/S364K/E357Q

SEQ ID NO: 539 - protein, 114 aa, Artificial Sequence; identical to SEQ ID NO: 2
  Description of Artificial Sequence: Synthetic polypeptide
  Chain 3 - IL-15

SEQ ID NO: 540 - protein, 480 aa, Artificial Sequence; identical to SEQ ID NO: 526
  Description of Artificial Sequence: Synthetic polypeptide
  Chain 1 - 1G6_L1.194_H1.279_scFv(GKPGS)4_ Fc(216)_IgG1_pI(-) _Isosteric_A_C220S/PVA_/S267K/L368D/K370S

SEQ ID NO: 541 - protein, 107 aa, Artificial Sequence; identical to SEQ ID NO: 132
  Description of Artificial Sequence: Synthetic polypeptide
  VL of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 542 - protein, 122 aa, Artificial Sequence; identical to SEQ ID NO: 127
  Description of Artificial Sequence: Synthetic polypeptide
  VH of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 543 - protein, 231 aa, Artificial Sequence; identical to SEQ ID NO: 64
  Description of Artificial Sequence: Synthetic polypeptide
  Fc chain of Chain 1 - 1G6_L1.194_H1.279_scFv(GKPGS)4_ Fc(216) _IgG1_pI(-)_Isosteric_A_C220S/PVA_/S267K/L368D/K370S

SEQ ID NO: 544 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR1
RASQSVGNDVA

SEQ ID NO: 545 - protein, 7 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR2
YASHRYT

SEQ ID NO: 546 - protein, 9 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR3
QQDFSSPRT

SEQ ID NO: 547 - protein, 5 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR1
NYWMN

SEQ ID NO: 548 - protein, 19 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR2
EIRLYSNNYATHYAESVKG

SEQ ID NO: 549 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR3
YYGNYGGYFDV

SEQ ID NO: 550 - protein, 299 aa, Artificial Sequence; identical to SEQ ID NO: 330
  Description of Artificial Sequence: Synthetic polypeptide
  Chain 2 - human_IL15Ralpha(sushi-D96/C97/A98)_ Fc(216)_IgG1 _C220S/PVA_/S267K/S364K/E357Q

SEQ ID NO: 551 - protein, 68 aa, Artificial Sequence; identical to SEQ ID NO: 284
  Description of Artificial Sequence: Synthetic polypeptide
  Chain 2 - human_IL15Ralpha(sushi-D96/C97/A98)_ Fc(216)_IgG1 _C220S/PVA_/S267K/S364K/E357Q human IL15Ralpha(sushi)

SEQ ID NO: 552 - protein, 231 aa, Artificial Sequence; identical to SEQ ID NO: 63
  Description of Artificial Sequence: Synthetic polypeptide
  Fc chain of Chain 2 - human_IL15Ralpha(sushi-D96/C97/A98) _ Fc(216)_IgG1_C220S/PVA_/S267K/S364K/E357Q

SEQ ID NO: 553 - protein, 114 aa, Artificial Sequence; identical to SEQ ID NO: 274
  Description of Artificial Sequence: Synthetic polypeptide
  Chain 3 - IL-15(E87C)

SEQ ID NO: 554 - protein, 440 aa, Artificial Sequence; identical to SEQ ID NO: 233
  Description of Artificial Sequence: Synthetic polypeptide
  XENP022022 Chain 1 - human_IL15Ralpha(sushi)_(GGGGS)6-human _IL15(single-chain)_ IgG1_pI(-)_Isosteric_A_/PVA _/S267K/L368D/K370S

SEQ ID NO: 555 - protein, 65 aa, Artificial Sequence; identical to SEQ ID NO: 4
  Description of Artificial Sequence: Synthetic polypeptide
  XENP022022 human IL15Ralpha(sushi)

SEQ ID NO: 556 - protein, 114 aa, Artificial Sequence; identical to SEQ ID NO: 2
  Description of Artificial Sequence: Synthetic polypeptide
  XENP022022 human IL15

SEQ ID NO: 557 - protein, 231 aa, Artificial Sequence; identical to SEQ ID NO: 64
  Description of Artificial Sequence: Synthetic polypeptide
  Fc chain of XENP022022

SEQ ID NO: 558 - protein, 451 aa, Artificial Sequence
  Description of Artificial Sequence: Synthetic polypeptide
  XENP022022 Chain 2 - 1G6_H1.278 [PD-1]_IgG1_C220S/PVA _/S267K/S364K/E357Q
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - protein, 122 aa, Artificial Sequence
  Description of Artificial Sequence: Synthetic polypeptide
  VH of XENP022022
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 560 - protein, 5 aa, Artificial Sequence
  Description of Artificial Sequence: Synthetic peptide
  XENP022022 vhCDR1
NYWMN

SEQ ID NO: 561 - protein, 19 aa, Artificial Sequence
  Description of Artificial Sequence: Synthetic peptide
  XENP022022 vhCDR2
EIRLYSNNYATHYAESVKG

SEQ ID NO: 562 - protein, 11 aa, Artificial Sequence
  Description of Artificial Sequence: Synthetic peptide
  XENP022022 vhCDR3
YYGNYGGYFDV

SEQ ID NO: 563 - protein, 214 aa, Artificial Sequence
  Description of Artificial Sequence: Synthetic polypeptide
  XENP022022 Chain 3 - 1G6_L1.188[PD-1]
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 564 - protein, 107 aa, Artificial Sequence
  Description of Artificial Sequence: Synthetic polypeptide
  VL of XENP022022
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 565 - protein, 11 aa, Artificial Sequence
  Description of Artificial Sequence: Synthetic peptide
  XENP022022 vlCDR1
RASQSVGNDVA

SEQ ID NO: 566 - protein, 7 aa, Artificial Sequence
  Description of Artificial Sequence: Synthetic peptide
  XENP022022 vlCDR2
YASHRYT

SEQ ID NO: 567 - protein, 9 aa, Artificial Sequence
  Description of Artificial Sequence: Synthetic peptide
  XENP022022 vlCDR3
QQDFSSPRT

SEQ ID NO: 568 - protein, 446 aa, Artificial Sequence
  Description of Artificial Sequence: Synthetic polypeptide
  XENP025849 Chain 1 - 1C11[PD-1]_H3_ IgG1_PVA _/S267K/S364K/E357Q
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 569 - protein, 117 aa, Artificial Sequence; identical to SEQ ID NO: 192
  Description of Artificial Sequence: Synthetic polypeptide
  VH of XENP025849

SEQ ID NO: 570 - protein, 5 aa, Artificial Sequence
  Description of Artificial Sequence: Synthetic peptide
  XENP025849 vhCDR1
HYGMN

SEQ ID NO: 571 - protein, 17 aa, Artificial Sequence
  Description of Artificial Sequence: Synthetic peptide
  XENP025849 vhCDR2
WINTYTGEPTYADGFTG

SEQ ID NO: 572 - protein, 8 aa, Artificial Sequence
  Description of Artificial Sequence: Synthetic peptide
  XENP025849 vhCDR3
DYYGSSPY

SEQ ID NO: 573 - protein, 435 aa, Artificial Sequence
  Description of Artificial Sequence: Synthetic polypeptide
  XENP025849 Chain 2 - human_IL15Ralpha(sushi)_(GGGGS)5-human _IL15(single-chain)_Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 574 - protein, 65 aa, Artificial Sequence; identical to SEQ ID NO: 4
  Description of Artificial Sequence: Synthetic polypeptide
  XENP025849 human IL15Ralpha(sushi)

SEQ ID NO: 575 - protein, 114 aa, Artificial Sequence; identical to SEQ ID NO: 2
  Description of Artificial Sequence: Synthetic polypeptide
  XENP025849 human IL15

SEQ ID NO: 576 - protein, 231 aa, Artificial Sequence; identical to SEQ ID NO: 64
  Description of Artificial Sequence: Synthetic polypeptide
  Fc chain of XENP025849

SEQ ID NO: 577 - protein, 219 aa, Artificial Sequence; identical to SEQ ID NO: 216
  Description of Artificial Sequence: Synthetic polypeptide
  XENP025849 Chain 3 - 1C11[PD-1]_L3

SEQ ID NO: 578 - protein, 112 aa, Artificial Sequence; identical to SEQ ID NO: 196
  Description of Artificial Sequence: Synthetic polypeptide
  VL of XENP025849

SEQ ID NO: 579 - protein, 16 aa, Artificial Sequence
  Description of Artificial Sequence: Synthetic peptide
  XENP025849 vlCDR1
KSSQSIVHSNGNTYLE

SEQ ID NO: 580 - protein, 7 aa, Artificial Sequence
  Description of Artificial Sequence: Synthetic peptide
  XENP025849 vlCDR2
KVSNRFS

SEQ ID NO: 581 - protein, 9 aa, Artificial Sequence
  Description of Artificial Sequence: Synthetic peptide
  XENP025849 vlCDR3
FQGSHVPNT

SEQ ID NO: 582 - protein, 446 aa, Artificial Sequence; identical to SEQ ID NO: 568
  Description of Artificial Sequence: Synthetic polypeptide
  XENP024535 Chain 1 - 1C11[PD-1]_H3_ IgG1_PVA _/S267K/S364K/E357Q

SEQ ID NO: 583 - protein, 117 aa, Artificial Sequence; identical to SEQ ID NO: 192
  Description of Artificial Sequence: Synthetic polypeptide
  VH of XENP024535

SEQ ID NO: 584 - protein, 5 aa, Artificial Sequence
  Description of Artificial Sequence: Synthetic peptide
  XENP024535 vhCDR1
HYGMN

SEQ ID NO: 585 - protein, 17 aa, Artificial Sequence
  Description of Artificial Sequence: Synthetic peptide
  XENP024535 vhCDR2
WINTYTGEPTYADGFTG

SEQ ID NO: 586 - protein, 8 aa, Artificial Sequence
  Description of Artificial Sequence: Synthetic peptide
  XENP024535 vhCDR3
DYYGSSPY

SEQ ID NO: 587 - protein, 435 aa, Artificial Sequence
  Description of Artificial Sequence: Synthetic polypeptide
  XENP024535 Chain 2 - human_IL15Ralpha(sushi)_(GGGGS)5-human _IL15(N65D;single-chain)_ Fc(216)_IgG1_pI (-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 588 - protein, 65 aa, Artificial Sequence; identical to SEQ ID NO: 4
  Description of Artificial Sequence: Synthetic polypeptide
  XENP024535 human IL15Ralpha(sushi)

SEQ ID NO: 589 - protein, 114 aa, Artificial Sequence; identical to SEQ ID NO: 358
  Description of Artificial Sequence: Synthetic polypeptide
  XENP024535 human IL15

SEQ ID NO: 590 - protein, 231 aa, Artificial Sequence; identical to SEQ ID NO: 64
  Description of Artificial Sequence: Synthetic polypeptide
  Fc chain of XENP024535

SEQ ID NO: 591 - protein, 219 aa, Artificial Sequence; identical to SEQ ID NO: 216
  Description of Artificial Sequence: Synthetic polypeptide
  XENP024535 Chain 3 - 1C11[PD-1]_L3

SEQ ID NO: 592 - protein, 112 aa, Artificial Sequence; identical to SEQ ID NO: 196
  Description of Artificial Sequence: Synthetic polypeptide
  VL of XENP024535

SEQ ID NO: 593 - protein, 16 aa, Artificial Sequence
  Description of Artificial Sequence: Synthetic peptide
  XENP024535 vlCDR1
KSSQSIVHSNGNTYLE

SEQ ID NO: 594 - protein, 7 aa, Artificial Sequence
  Description of Artificial Sequence: Synthetic peptide
  XENP024535 vlCDR2
KVSNRFS

SEQ ID NO: 595 - protein, 9 aa, Artificial Sequence
  Description of Artificial Sequence: Synthetic peptide
  XENP024535 vlCDR3
FQGSHVPNT

SEQ ID NO: 596 - protein, 446 aa, Artificial Sequence; identical to SEQ ID NO: 568
  Description of Artificial Sequence: Synthetic polypeptide
  XENP024536 Chain 1 - 1C11[PD-1]_H3_ IgG1_PVA _/S267K/S364K/E357Q

SEQ ID NO: 597 - protein, 117 aa, Artificial Sequence; identical to SEQ ID NO: 192
  Description of Artificial Sequence: Synthetic polypeptide
  VH of XENP024536

SEQ ID NO: 598 - protein, 5 aa, Artificial Sequence
  Description of Artificial Sequence: Synthetic peptide
  XENP024536 vhCDR1
HYGMN

SEQ ID NO: 599 - protein, 17 aa, Artificial Sequence
  Description of Artificial Sequence: Synthetic peptide
  XENP024536 vhCDR2
WINTYTGEPTYADGFTG

SEQ ID NO: 600 - protein, 8 aa, Artificial Sequence
  Description of Artificial Sequence: Synthetic peptide
  XENP024536 vhCDR3
DYYGSSPY

SEQ ID NO: 601 - protein, 435 aa, Artificial Sequence; identical to SEQ ID NO: 442
  Description of Artificial Sequence: Synthetic polypeptide
  XENP024536 Chain 2 - human_IL15Ralpha(sushi)_(GGGGS)5-human _IL15(Q108E;single-chain)_ Fc(216)_IgG1_pI (-)_Isosteric_A_C220S/PVA_/S267K/L368D/K370S

SEQ ID NO: 602 - protein, 65 aa, Artificial Sequence; identical to SEQ ID NO: 4
  Description of Artificial Sequence: Synthetic polypeptide
  XENP024536 human IL15Ralpha(sushi)

SEQ ID NO: 603 - protein, 114 aa, Artificial Sequence; identical to SEQ ID NO: 359
  Description of Artificial Sequence: Synthetic polypeptide
  XENP024536 human IL15

SEQ ID NO: 604 - protein, 231 aa, Artificial Sequence; identical to SEQ ID NO: 64
  Description of Artificial Sequence: Synthetic polypeptide
  Fc chain of XENP024536

SEQ ID NO: 605 - protein, 219 aa, Artificial Sequence; identical to SEQ ID NO: 216
  Description of Artificial Sequence: Synthetic polypeptide
  XENP024536 Chain 3 - 1C11[PD-1]_L3

SEQ ID NO: 606 - protein, 112 aa, Artificial Sequence; identical to SEQ ID NO: 196
  Description of Artificial Sequence: Synthetic polypeptide
  VL of XENP024536

SEQ ID NO: 607 - protein, 16 aa, Artificial Sequence
  Description of Artificial Sequence: Synthetic peptide
  XENP024536 vlCDR1
KSSQSIVHSNGNTYLE

SEQ ID NO: 608 - protein, 7 aa, Artificial Sequence
  Description of Artificial Sequence: Synthetic peptide
  XENP024536 vlCDR2
KVSNRFS

SEQ ID NO: 609 - protein, 9 aa, Artificial Sequence
  Description of Artificial Sequence: Synthetic peptide
  XENP024536 vlCDR3
FQGSHVPNT

SEQ ID NO: 610 - protein, 446 aa, Artificial Sequence; identical to SEQ ID NO: 568
  Description of Artificial Sequence: Synthetic polypeptide
  XENP025850 Chain 1 - 1C11[PD-1]_H3L3_ IgG1_PVA _/S267K/S364K/E357Q

SEQ ID NO: 611 - protein, 117 aa, Artificial Sequence; identical to SEQ ID NO: 192
  Description of Artificial Sequence: Synthetic polypeptide
  VH of XENP025850

SEQ ID NO: 612 - protein, 5 aa, Artificial Sequence
  Description of Artificial Sequence: Synthetic peptide
  XENP025850 vhCDR1
HYGMN

SEQ ID NO: 613 - protein, 17 aa, Artificial Sequence
  Description of Artificial Sequence: Synthetic peptide
  XENP025850 vhCDR2
WINTYTGEPTYADGFTG

SEQ ID NO: 614 - protein, 8 aa, Artificial Sequence
  Description of Artificial Sequence: Synthetic peptide
  XENP025850 vhCDR3
DYYGSSPY

SEQ ID NO: 615 - protein, 435 aa, Artificial Sequence; identical to SEQ ID NO: 447
  Description of Artificial Sequence: Synthetic polypeptide
  XENP025850 Chain 2 - human_IL15Ralpha(sushi)_(GGGGS)5-human _IL15(N4D/N65D;single-chain)_ Fc(216)_IgG1_pI (-)_Isosteric_A_C220S/PVA_/S267K/L368D/K370S

SEQ ID NO: 616 - protein, 65 aa, Artificial Sequence; identical to SEQ ID NO: 4
  Description of Artificial Sequence: Synthetic polypeptide
  XENP025850 human IL15Ralpha(sushi)

SEQ ID NO: 617 - protein, 114 aa, Artificial Sequence; identical to SEQ ID NO: 374
  Description of Artificial Sequence: Synthetic polypeptide
  XENP025850 human IL15

SEQ ID NO: 618 - protein, 231 aa, Artificial Sequence; identical to SEQ ID NO: 64
  Description of Artificial Sequence: Synthetic polypeptide
  Fc chain of XENP025850

SEQ ID NO: 619 - protein, 219 aa, Artificial Sequence; identical to SEQ ID NO: 216
  Description of Artificial Sequence: Synthetic polypeptide
  XENP025850 Chain 3 - 1C11[PD-1]_L3

SEQ ID NO: 620 - protein, 112 aa, Artificial Sequence; identical to SEQ ID NO: 196
  Description of Artificial Sequence: Synthetic polypeptide
  VL of XENP025850

SEQ ID NO: 621 - protein, 16 aa, Artificial Sequence
  Description of Artificial Sequence: Synthetic peptide
  XENP025850 vlCDR1
KSSQSIVHSNGNTYLE

SEQ ID NO: 622 - protein, 7 aa, Artificial Sequence
  Description of Artificial Sequence: Synthetic peptide
  XENP025850 vlCDR2
KVSNRFS

SEQ ID NO: 623 - protein, 9 aa, Artificial Sequence
  Description of Artificial Sequence: Synthetic peptide
  XENP025850 vlCDR3
FQGSHVPNT

SEQ ID NO: 624 - protein, 446 aa, Artificial Sequence
  Description of Artificial Sequence: Synthetic polypeptide
  XENP025937 Chain 1 - 1C11[PD-1]_H3_ IgG1_PVA _/S267K/S364K/E357Q/M428L/N434S
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 625 - protein, 117 aa, Artificial Sequence; identical to SEQ ID NO: 192
  Description of Artificial Sequence: Synthetic polypeptide
  VH of XENP025937

SEQ ID NO: 626 - protein, 5 aa, Artificial Sequence
  Description of Artificial Sequence: Synthetic peptide
  XENP025937 vhCDR1
HYGMN

SEQ ID NO: 627 - protein, 17 aa, Artificial Sequence
  Description of Artificial Sequence: Synthetic peptide
  XENP025937 vhCDR2
WINTYTGEPTYADGFTG

SEQ ID NO: 628 - protein, 8 aa, Artificial Sequence
  Description of Artificial Sequence: Synthetic peptide
  XENP025937 vhCDR3
DYYGSSPY

SEQ ID NO: 629 - protein, 435 aa, Artificial Sequence
  Description of Artificial Sequence: Synthetic polypeptide
  XENP025937 Chain 2 - human_IL15Ralpha(sushi)_(GGGGS)5-human _IL15(N4D/N65D;single-chain)_ Fc(216)_IgG1_pI (-)_Isosteric_A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 630 - protein, 65 aa, Artificial Sequence; identical to SEQ ID NO: 4
  Description of Artificial Sequence: Synthetic polypeptide
  XENP025937 human IL15Ralpha(sushi)

SEQ ID NO: 631 - protein, 114 aa, Artificial Sequence; identical to SEQ ID NO: 374
  Description of Artificial Sequence: Synthetic polypeptide
  XENP025937 human IL15

SEQ ID NO: 632 - protein, 231 aa, Artificial Sequence; identical to SEQ ID NO: 84
  Description of Artificial Sequence: Synthetic polypeptide
  Fc chain of XENP025937

SEQ ID NO: 633 - protein, 219 aa, Artificial Sequence; identical to SEQ ID NO: 216
  Description of Artificial Sequence: Synthetic polypeptide
  XENP025937 Chain 3 - 1C11[PD-1]_L3

SEQ ID NO: 634 - protein, 112 aa, Artificial Sequence; identical to SEQ ID NO: 196
  Description of Artificial Sequence: Synthetic polypeptide
  VL of XENP025937

SEQ ID NO: 635 - protein, 16 aa, Artificial Sequence
  Description of Artificial Sequence: Synthetic peptide
  XENP025937 vlCDR1
KSSQSIVHSNGNTYLE

SEQ ID NO: 636 - protein, 7 aa, Artificial Sequence
  Description of Artificial Sequence: Synthetic peptide
  XENP025937 vlCDR2
KVSNRFS

SEQ ID NO: 637 - protein, 9 aa, Artificial Sequence
  Description of Artificial Sequence: Synthetic peptide
  XENP025937 vlCDR3
FQGSHVPNT

SEQ ID NO: 638 - protein, 114 aa, Artificial Sequence; identical to SEQ ID NO: 2
  Description of Artificial Sequence: Synthetic polypeptide
  XENP022112 Chain 1 - IL-15

SEQ ID NO: 639 - protein, 451 aa, Artificial Sequence
  Description of Artificial Sequence: Synthetic polypeptide
  XENP022112 Chain 2 - 1G6_H1.278[PD-1] _IgG1_pI(-)_Isosteric_A _C220S/PVA_/S267K/L368D/K370S
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 640 - protein, 122 aa, Artificial Sequence; identical to SEQ ID NO: 559
  Description of Artificial Sequence: Synthetic polypeptide
  VH of XENP022112

SEQ ID NO: 641 - protein, 5 aa, Artificial Sequence
  Description of Artificial Sequence: Synthetic peptide
  XENP022112 vhCDR1
NYWMN

SEQ ID NO: 642 - protein, 19 aa, Artificial Sequence
  Description of Artificial Sequence: Synthetic peptide
  XENP022112 vhCDR2
EIRLYSNNYATHYAESVKG

SEQ ID NO: 643 - protein, 11 aa, Artificial Sequence
  Description of Artificial Sequence: Synthetic peptide
  XENP022112 vhCDR3
YYGNYGGYFDV

SEQ ID NO: 644 - protein, 296 aa, Artificial Sequence; identical to SEQ ID NO: 230
  Description of Artificial Sequence: Synthetic polypeptide
  XENP022112 Chain 3 - human_IL15Ralpha(Sushi)_Fc(216)_ IgG1 _C220S/PVA_/S267K/S364K/E357Q

SEQ ID NO: 645 - protein, 65 aa, Artificial Sequence; identical to SEQ ID NO: 4
  Description of Artificial Sequence: Synthetic polypeptide
  XENP022112 human IL15Ralpha(Sushi)

SEQ ID NO: 646 - protein, 231 aa, Artificial Sequence; identical to SEQ ID NO: 63
  Description of Artificial Sequence: Synthetic polypeptide
  Fc chain of XENP022112

SEQ ID NO: 647 - protein, 214 aa, Artificial Sequence; identical to SEQ ID NO: 563
  Description of Artificial Sequence: Synthetic polypeptide
  XENP022112 Chain 4 - 1G6_L1.188[PD-1]

SEQ ID NO: 648 - protein, 107 aa, Artificial Sequence; identical to SEQ ID NO: 564
  Description of Artificial Sequence: Synthetic polypeptide
  VL of XENP022112

SEQ ID NO: 649 - protein, 11 aa, Artificial Sequence
  Description of Artificial Sequence: Synthetic peptide
  XENP022112 vlCDR1
RASQSVGNDVA

SEQ ID NO: 650 - protein, 7 aa, Artificial Sequence
  Description of Artificial Sequence: Synthetic peptide
  XENP022112 vlCDR2
YASHRYT

SEQ ID NO: 651 - protein, 9 aa, Artificial Sequence
  Description of Artificial Sequence: Synthetic peptide
  XENP022112 vlCDR3
QQDFSSPRT

SEQ ID NO: 652 - protein, 114 aa, Artificial Sequence; identical to SEQ ID NO: 274
  Description of Artificial Sequence: Synthetic polypeptide
  XENP022641 Chain 1 - IL-15(E87C)

SEQ ID NO: 653 - protein, 451 aa, Artificial Sequence; identical to SEQ ID NO: 639
  Description of Artificial Sequence: Synthetic polypeptide
  XENP022641 Chain 2 - 1G6_H1.278_ IgG1_pI(-)_Isosteric_A _C220S/PVA_/S267K/L368D/K370S

SEQ ID NO: 654 - protein, 122 aa, Artificial Sequence; identical to SEQ ID NO: 559
  Description of Artificial Sequence: Synthetic polypeptide
  VH of XENP022641

SEQ ID NO: 655 - protein, 5 aa, Artificial Sequence
  Description of Artificial Sequence: Synthetic peptide
  XENP022641 vhCDR1
NYWMN

SEQ ID NO: 656 - protein, 19 aa, Artificial Sequence
  Description of Artificial Sequence: Synthetic peptide
  XENP022641 vhCDR2
EIRLYSNNYATHYAESVKG

SEQ ID NO: 657 - protein, 11 aa, Artificial Sequence
  Description of Artificial Sequence: Synthetic peptide
  XENP022641 vhCDR3
YYGNYGGYFDV

SEQ ID NO: 658 - protein, 298 aa, Artificial Sequence; identical to SEQ ID NO: 504
  Description of Artificial Sequence: Synthetic polypeptide
  XENP022641 Chain 3 - human_IL15Ralpha(Sushi-D96/C97)_Fc(216) _ IgG1_C220S/PVA_/S267K/S364K/E357Q

SEQ ID NO: 659 - protein, 67 aa, Artificial Sequence; identical to SEQ ID NO: 282
  Description of Artificial Sequence: Synthetic polypeptide
  XENP022641 human IL15Ralpha(Sushi)

SEQ ID NO: 660 - protein, 231 aa, Artificial Sequence; identical to SEQ ID NO: 63
  Description of Artificial Sequence: Synthetic polypeptide
  Fc chain of XENP022641

SEQ ID NO: 661 - protein, 214 aa, Artificial Sequence; identical to SEQ ID NO: 563
  Description of Artificial Sequence: Synthetic polypeptide
  XENP022641 Chain 4 - 1G6_L1.188[PD-1]

SEQ ID NO: 662 - protein, 107 aa, Artificial Sequence; identical to SEQ ID NO: 564
  Description of Artificial Sequence: Synthetic polypeptide
  VL of XENP022641

SEQ ID NO: 663 - protein, 11 aa, Artificial Sequence
  Description of Artificial Sequence: Synthetic peptide
  XENP022641 vhCDR1
RASQSVGNDVA

SEQ ID NO: 664 - protein, 7 aa, Artificial Sequence
  Description of Artificial Sequence: Synthetic peptide
  XENP022641 vhCDR2
YASHRYT

SEQ ID NO: 665 - protein, 9 aa, Artificial Sequence
  Description of Artificial Sequence: Synthetic peptide
  XENP022641 vhCDR3
QQDFSSPRT

SEQ ID NO: 666 - protein, 659 aa, Artificial Sequence
  Description of Artificial Sequence: Synthetic polypeptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D)
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 667 - protein, 117 aa, Artificial Sequence; identical to SEQ ID NO: 192
  Description of Artificial Sequence: Synthetic polypeptide
  VH of Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D)

SEQ ID NO: 668 - protein, 65 aa, Artificial Sequence; identical to SEQ ID NO: 4
  Description of Artificial Sequence: Synthetic polypeptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) IL15Ralpha(sushi)

SEQ ID NO: 669 - protein, 114 aa, Artificial Sequence; identical to SEQ ID NO: 374
  Description of Artificial Sequence: Synthetic polypeptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) IL15

SEQ ID NO: 670 - protein, 5 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) vhCDR1
HYGMN

SEQ ID NO: 671 - protein, 17 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) vhCDR2
WINTYTGEPTYADGFTG

SEQ ID NO: 672 - protein, 8 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) vhCDR3
DYYGSSPY

SEQ ID NO: 673 - protein, 446 aa, Artificial Sequence; identical to SEQ ID NO: 568
  Description of Artificial Sequence: Synthetic polypeptide
  Chain 2 - 1C11[PD-1]_H3_ IgG1_ PVA_/S267K/S364K/E357Q

SEQ ID NO: 674 - protein, 117 aa, Artificial Sequence; identical to SEQ ID NO: 192
  Description of Artificial Sequence: Synthetic polypeptide
  VH of Chain 2 - 1C11[PD-1]_H3_ IgG1_ PVA_/S267K/S364K/E357Q

SEQ ID NO: 675 - protein, 5 aa, Artificial Sequence
  Description of Artificial Sequence: Synthetic peptide
  Chain 2 - 1C11[PD-1]_H3_ IgG1_ PVA_/S267K/S364K/E357Q vhCDR1
HYGMN

SEQ ID NO: 676 - protein, 17 aa, Artificial Sequence
  Description of Artificial Sequence: Synthetic peptide
  Chain 2 - 1C11[PD-1]_H3_ IgG1_ PVA_/S267K/S364K/E357Q vhCDR2
WINTYTGEPTYADGFTG

SEQ ID NO: 677 - protein, 8 aa, Artificial Sequence
  Description of Artificial Sequence: Synthetic peptide
  Chain 2 - 1C11[PD-1]_H3_ IgG1_ PVA_/S267K/S364K/E357Q vhCDR3
DYYGSSPY

SEQ ID NO: 678 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 679 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 680 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 681 - protein, 7 aa, Artificial Sequence
  Description of Artificial Sequence: Synthetic peptide
  Chain 3 - 1C11[PD-1]_L3 vlCDR2
KVSNRFS

SEQ ID NO: 682 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 683 - protein, 660 aa, Artificial Sequence
  Description of Artificial Sequence: Synthetic polypeptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain)
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 684 - protein, 117 aa, Artificial Sequence; identical to SEQ ID NO: 192
  Description of Artificial Sequence: Synthetic polypeptide
  VH of Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain)

SEQ ID NO: 685 - protein, 65 aa, Artificial Sequence; identical to SEQ ID NO: 4
  Description of Artificial Sequence: Synthetic polypeptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) IL15Ralpha(Sushi)

SEQ ID NO: 686 - protein, 114 aa, Artificial Sequence; identical to SEQ ID NO: 2
  Description of Artificial Sequence: Synthetic polypeptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) IL15

SEQ ID NO: 687 - protein, 5 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) vhCDR1
HYGMN

SEQ ID NO: 688 - protein, 17 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) vhCDR2
WINTYTGEPTYADGFTG

SEQ ID NO: 689 - protein, 8 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) vhCDR3
DYYGSSPY

SEQ ID NO: 690 - protein, 446 aa, Artificial Sequence
  Description of Artificial Sequence: Synthetic polypeptide
  Chain 2 - 1C11[PD-1]_H3_IgG1_pI_ISO(+RR)_/PVA _/S267K/S364K/E357Q
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 691 - protein, 117 aa, Artificial Sequence; identical to SEQ ID NO: 192
  Description of Artificial Sequence: Synthetic polypeptide
  VH of Chain 2 - 1C11[PD-1]_H3_IgG1_pI_ISO(+RR)_/PVA _/S267K/S364K/E357Q

SEQ ID NO: 692 - protein, 5 aa, Artificial Sequence
  Description of Artificial Sequence: Synthetic peptide
  Chain 2 - 1C11[PD-1]_H3_IgG1_pI_ISO(+RR)_/PVA _/S267K/S364K/E357Q vhCDR1
HYGMN

SEQ ID NO: 693 - protein, 17 aa, Artificial Sequence
  Description of Artificial Sequence: Synthetic peptide
  Chain 2 - 1C11[PD-1]_H3_IgG1_pI_ISO(+RR)_/PVA _/S267K/S364K/E357Q vhCDR2
WINTYTGEPTYADGFTG

SEQ ID NO: 694 - protein, 8 aa, Artificial Sequence
  Description of Artificial Sequence: Synthetic peptide
  Chain 2 - 1C11[PD-1]_H3_IgG1_pI_ISO(+RR)_/PVA _/S267K/S364K/E357Q vhCDR3
DYYGSSPY

SEQ ID NO: 695 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 696 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 697 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 698 - protein, 7 aa, Artificial Sequence
  Description of Artificial Sequence: Synthetic peptide
  Chain 3 - 1C11[PD-1]_L3 vlCDR2
KVSNRFS

SEQ ID NO: 699 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 700 - protein, 446 aa, Artificial Sequence
  Description of Artificial Sequence: Synthetic polypeptide
  Chain 1 - 1C11[PD-1]_H3_ IgG1_pI(-)_Isosteric_A_PVA _/S267K/L368D/K370S
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 701 - protein, 117 aa, Artificial Sequence; identical to SEQ ID NO: 192
  Description of Artificial Sequence: Synthetic polypeptide
  VH of Chain 1 - 1C11[PD-1]_H3_ IgG1_pI(-)_Isosteric_A_PVA _/S267K/L368D/K370S

SEQ ID NO: 702 - protein, 5 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S vhCDR1
HYGMN

SEQ ID NO: 703 - protein, 17 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S vhCDR2
WINTYTGEPTYADGFTG

SEQ ID NO: 704 - protein, 8 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S vhCDR3
DYYGSSPY

SEQ ID NO: 705 - protein, 660 aa, Artificial Sequence
  Description of Artificial Sequence: Synthetic polypeptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain)
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 706 - protein, 117 aa, Artificial Sequence; identical to SEQ ID NO: 192
  Description of Artificial Sequence: Synthetic polypeptide
  VH of Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain)

SEQ ID NO: 707 - protein, 65 aa, Artificial Sequence; identical to SEQ ID NO: 4
  Description of Artificial Sequence: Synthetic polypeptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) IL15Ralpha(Sushi)

SEQ ID NO: 708 - protein, 114 aa, Artificial Sequence; identical to SEQ ID NO: 2
  Description of Artificial Sequence: Synthetic polypeptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) IL15

SEQ ID NO: 709 - protein, 5 aa, Artificial Sequence
  Description of Artificial Sequence: Synthetic peptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) vhCDR1
HYGMN

SEQ ID NO: 710 - protein, 17 aa, Artificial Sequence
  Description of Artificial Sequence: Synthetic peptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) vhCDR2
WINTYTGEPTYADGFTG

SEQ ID NO: 711 - protein, 8 aa, Artificial Sequence
  Description of Artificial Sequence: Synthetic peptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) vhCDR3
DYYGSSPY

SEQ ID NO: 712 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 713 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 714 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 715 - protein, 7 aa, Artificial Sequence
  Description of Artificial Sequence: Synthetic peptide
  Chain 3 - 1C11[PD-1]_L3 vlCDR2
KVSNRFS

SEQ ID NO: 716 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 717 - protein, 114 aa, Artificial Sequence; identical to SEQ ID NO: 2
  Description of Artificial Sequence: Synthetic polypeptide
  XENP022642 Chain 1 - IL-15

SEQ ID NO: 718 - protein, 517 aa, Artificial Sequence
  Description of Artificial Sequence: Synthetic polypeptide
  XENP022642 Chain 2 - Nivolumab_H0_ IgG1_pI(-)_Isosteric_A_PVA _/S267K/L368D/K370S__(GGGGS)2_IL15Ralpha(Sushi)
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 719 - protein, 113 aa, Artificial Sequence [sequence omitted]

SEQ ID NO: 720 - protein, 65 aa, Artificial Sequence; identical to SEQ ID NO: 4
  Description of Artificial Sequence: Synthetic polypeptide
  XENP022642 IL15Ralpha(Sushi)

SEQ ID NO: 721 - protein, 5 aa, Artificial Sequence
  Description of Artificial Sequence: Synthetic peptide
  XENP022642 vhCDR1
NSGMH

SEQ ID NO: 722 - protein, 17 aa, Artificial Sequence
  Description of Artificial Sequence: Synthetic peptide
  XENP022642 vhCDR2
VIWYDGSKRYYADSVKG

SEQ ID NO: 723 - protein, 4 aa, Artificial Sequence
  Description of Artificial Sequence: Synthetic peptide
  XENP022642 vhCDR3
NDDY

SEQ ID NO: 724 - protein, 442 aa, Artificial Sequence
  Description of Artificial Sequence: Synthetic polypeptide
  XENP022642 Chain 3 - Nivolumab_H0_IgG1_pI_ISO(+RR)_/PVA _/S267K/S364K/E357Q
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 725 - protein, 113 aa, Artificial Sequence [sequence omitted]

SEQ ID NO: 726 - protein, 5 aa, Artificial Sequence
  Description of Artificial Sequence: Synthetic peptide
  XENP022642 vhCDR1
NSGMH

SEQ ID NO: 727 - protein, 17 aa, Artificial Sequence
  Description of Artificial Sequence: Synthetic peptide
  XENP022642 vhCDR2
VIWYDGSKRYYADSVKG

SEQ ID NO: 728 - protein, 4 aa, Artificial Sequence
  Description of Artificial Sequence: Synthetic peptide
  XENP022642 vhCDR3
NDDY

SEQ ID NO: 729 - protein, 214 aa, Artificial Sequence; identical to SEQ ID NO: 106
  Description of Artificial Sequence: Synthetic polypeptide
  XENP022642 Chain 4 - Nivolumab_L0

SEQ ID NO: 730 - protein, 107 aa, Artificial Sequence [sequence omitted]

SEQ ID NO: 731 - protein, 11 aa, Artificial Sequence
  Description of Artificial Sequence: Synthetic peptide
  XENP022642 vlCDR1
RASQSVSSYLA

SEQ ID NO: 732 - protein, 7 aa, Artificial Sequence
  Description of Artificial Sequence: Synthetic peptide
  XENP022642 vlCDR2
DASNRAT

SEQ ID NO: 733 - protein, 9 aa, Artificial Sequence
  Description of Artificial Sequence: Synthetic peptide
  XENP022642 vlCDR3
QQSSNWPRT

SEQ ID NO: 734 - protein, 114 aa, Artificial Sequence; identical to SEQ ID NO: 2
  Description of Artificial Sequence: Synthetic polypeptide
  XENP022643 Chain 1 - IL-15

SEQ ID NO: 735 - protein, 442 aa, Artificial Sequence
  Description of Artificial Sequence: Synthetic polypeptide
  XENP022643 Chain 2 - Nivolumab_H0_ IgG1_pI(-)_Isosteric_A_PVA _/S267K/L368D/K370S
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 736 - protein, 113 aa, Artificial Sequence [sequence omitted]

SEQ ID NO: 737 - protein, 5 aa, Artificial Sequence
  Description of Artificial Sequence: Synthetic peptide
  XENP022643 vhCDR1
NSGMH

SEQ ID NO: 738 - protein, 17 aa, Artificial Sequence
  Description of Artificial Sequence: Synthetic peptide
  XENP022643 vhCDR2
VIWYDGSKRYYADSVKG

SEQ ID NO: 739 - protein, 4 aa, Artificial Sequence
  Description of Artificial Sequence: Synthetic peptide
  XENP022643 vhCDR3
NDDY

SEQ ID NO: 740 - protein, 517 aa, Artificial Sequence
  Description of Artificial Sequence: Synthetic polypeptide
  XENP022643 Chain 3 - Nivolumab_H0_ IgG1_pI_ISO(+RR)_/PVA _/S267K/S364K/E357Q_(GGGGS)2_IL15Ralpha(Sushi)
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 741 - protein, 113 aa, Artificial Sequence [sequence omitted]

SEQ ID NO: 742 - protein, 65 aa, Artificial Sequence; identical to SEQ ID NO: 4
  Description of Artificial Sequence: Synthetic polypeptide
  XENP022643 IL15Ralpha(Sushi)

SEQ ID NO: 743 - protein, 5 aa, Artificial Sequence
  Description of Artificial Sequence: Synthetic peptide
  XENP022643 vhCDR1
NSGMH

SEQ ID NO: 744 - protein, 17 aa, Artificial Sequence
  Description of Artificial Sequence: Synthetic peptide
  XENP022643 vhCDR2
VIWYDGSKRYYADSVKG

SEQ ID NO: 745 - protein, 4 aa, Artificial Sequence
  Description of Artificial Sequence: Synthetic peptide
  XENP022643 vhCDR3
NDDY

SEQ ID NO: 746 - protein, 214 aa, Artificial Sequence; identical to SEQ ID NO: 106
  Description of Artificial Sequence: Synthetic polypeptide
  XENP022643 Chain 4 - Nivolumab_L0

SEQ ID NO: 747 - protein, 107 aa, Artificial Sequence [sequence omitted]

SEQ ID NO: 748 - protein, 11 aa, Artificial Sequence
  Description of Artificial Sequence: Synthetic peptide
  XENP022643 vlCDR1
RASQSVSSYLA

SEQ ID NO: 749 - protein, 7 aa, Artificial Sequence
  Description of Artificial Sequence: Synthetic peptide
  XENP022643 vlCDR2
DASNRAT

SEQ ID NO: 750 - protein, 9 aa, Artificial Sequence
  Description of Artificial Sequence: Synthetic peptide
  XENP022643 vlCDR3
QQSSNWPRT

SEQ ID NO: 751 - protein, 114 aa, Artificial Sequence; identical to SEQ ID NO: 274
  Description of Artificial Sequence: Synthetic polypeptide
  XENP022644 Chain 1 - IL-15(E87C)

SEQ ID NO: 752 - protein, 519 aa, Artificial Sequence
  Description of Artificial Sequence: Synthetic polypeptide
  XENP022644 Chain 2 - Nivolumab_H0_IgG1_pI(-)_Isosteric_A_PVA _/S267K/L368D/K370S_(GGGGS)2_IL15Ralpha(Sushi-D96/C97)
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 753 - protein, 113 aa, Artificial Sequence [sequence omitted]

SEQ ID NO: 754 - protein, 67 aa, Artificial Sequence; identical to SEQ ID NO: 282
  Description of Artificial Sequence: Synthetic polypeptide
  XENP022644 IL15Ralpha(Sushi)

SEQ ID NO: 755 - protein, 5 aa, Artificial Sequence
  Description of Artificial Sequence: Synthetic peptide
  XENP022644 vhCDR1
NSGMH

SEQ ID NO: 756 - protein, 17 aa, Artificial Sequence
  Description of Artificial Sequence: Synthetic peptide
  XENP022644 vhCDR2
VIWYDGSKRYYADSVKG

SEQ ID NO: 757 - protein, 4 aa, Artificial Sequence
  Description of Artificial Sequence: Synthetic peptide
  XENP022644 vhCDR3
NDDY

SEQ ID NO: 758 - protein, 442 aa, Artificial Sequence; identical to SEQ ID NO: 724
  Description of Artificial Sequence: Synthetic polypeptide
  XENP022644 Chain 3 - Nivolumab_H0_ IgG1_pI_ISO(+RR)_/PVA _/S267K/S364K/E357Q

SEQ ID NO: 759 - protein, 113 aa, Artificial Sequence [sequence omitted]

SEQ ID NO: 760 - protein, 5 aa, Artificial Sequence
  Description of Artificial Sequence: Synthetic peptide
  XENP022644 vhCDR1
NSGMH

SEQ ID NO: 761 - protein, 17 aa, Artificial Sequence
  Description of Artificial Sequence: Synthetic peptide
  XENP022644 vhCDR2
VIWYDGSKRYYADSVKG

SEQ ID NO: 762 - protein, 4 aa, Artificial Sequence
  Description of Artificial Sequence: Synthetic peptide
  XENP022644 vhCDR3
NDDY

SEQ ID NO: 763 - protein, 214 aa, Artificial Sequence; identical to SEQ ID NO: 106
  Description of Artificial Sequence: Synthetic polypeptide
  XENP022644 Chain 4 - Nivolumab_L0

SEQ ID NO: 764 - protein, 107 aa, Artificial Sequence [sequence omitted]

SEQ ID NO: 765 - protein, 11 aa, Artificial Sequence
  Description of Artificial Sequence: Synthetic peptide
  XENP022644 vlCDR1
RASQSVSSYLA

SEQ ID NO: 766 - protein, 7 aa, Artificial Sequence
  Description of Artificial Sequence: Synthetic peptide
  XENP022644 vlCDR2
DASNRAT

SEQ ID NO: 767 - protein, 9 aa, Artificial Sequence
  Description of Artificial Sequence: Synthetic peptide
  XENP022644 vlCDR3
QQSSNWPRT

SEQ ID NO: 768 - protein, 114 aa, Artificial Sequence; identical to SEQ ID NO: 274
  Description of Artificial Sequence: Synthetic polypeptide
  XENP022645 Chain 1 - IL-15(E87C)

SEQ ID NO: 769 - protein, 442 aa, Artificial Sequence; identical to SEQ ID NO: 735
  Description of Artificial Sequence: Synthetic polypeptide
  XENP022645 Chain 2 - Nivolumab_H0_ IgG1_pI(-)_Isosteric_A_PVA _/S267K/L368D/K370S

SEQ ID NO: 770 - protein, 113 aa, Artificial Sequence [sequence omitted]

SEQ ID NO: 771 - protein, 5 aa, Artificial Sequence
  Description of Artificial Sequence: Synthetic peptide
  XENP022645 vhCDR1
NSGMH

SEQ ID NO: 772 - protein, 17 aa, Artificial Sequence
  Description of Artificial Sequence: Synthetic peptide
  XENP022645 vhCDR2
VIWYDGSKRYYADSVKG

SEQ ID NO: 773 - protein, 4 aa, Artificial Sequence
  Description of Artificial Sequence: Synthetic peptide
  XENP022645 vhCDR3
NDDY

SEQ ID NO: 774 - protein, 519 aa, Artificial Sequence
  Description of Artificial Sequence: Synthetic polypeptide
  XENP022645 Chain 3 - Nivolumab_H0_ IgG1_pI_ISO(+RR)_/PVA _/S267K/S364K/E357Q_(GGGGS)2_IL15Ralpha(Sushi-D96/C97)
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 775 - protein, 113 aa, Artificial Sequence [sequence omitted]

SEQ ID NO: 776 - protein, 67 aa, Artificial Sequence; identical to SEQ ID NO: 282
  Description of Artificial Sequence: Synthetic polypeptide
  XENP022645 IL15Ralpha(Sushi)

SEQ ID NO: 777 - protein, 5 aa, Artificial Sequence
  Description of Artificial Sequence: Synthetic peptide
  XENP022645 vhCDR1
NSGMH

SEQ ID NO: 778 - protein, 17 aa, Artificial Sequence
  Description of Artificial Sequence: Synthetic peptide
  XENP022645 vhCDR2
VIWYDGSKRYYADSVKG

SEQ ID NO: 779 - protein, 4 aa, Artificial Sequence
  Description of Artificial Sequence: Synthetic peptide
  XENP022645 vhCDR3
NDDY

SEQ ID NO: 780 - protein, 214 aa, Artificial Sequence; identical to SEQ ID NO: 106
  Description of Artificial Sequence: Synthetic polypeptide
  XENP022645 Chain 4 - Nivolumab_L0

SEQ ID NO: 781 - protein, 107 aa, Artificial Sequence [sequence omitted]

SEQ ID NO: 782 - protein, 11 aa, Artificial Sequence
  Description of Artificial Sequence: Synthetic peptide
  XENP022645 vhCDR1
RASQSVSSYLA

SEQ ID NO: 783 - protein, 7 aa, Artificial Sequence
  Description of Artificial Sequence: Synthetic peptide
  XENP022645 vhCDR2
DASNRAT

SEQ ID NO: 784 - protein, 9 aa, Artificial Sequence
  Description of Artificial Sequence: Synthetic peptide
  XENP022645 vhCDR3
QQSSNWPRT

SEQ ID NO: 785 - protein, 580 aa, Artificial Sequence
  Description of Artificial Sequence: Synthetic polypeptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 786 - protein, 117 aa, Artificial Sequence; identical to SEQ ID NO: 192
  Description of Artificial Sequence: Synthetic polypeptide
  VH of Chain 1 - 1C11[PD-1]_H3_IL15_N4D/N65D_(GGGGS)1_Fc(216) _IgG1_pI(-)_Isosteric_A_C220S/PVA_/S267K/L368D/K370S

SEQ ID NO: 787 - protein, 114 aa, Artificial Sequence; identical to SEQ ID NO: 374
  Description of Artificial Sequence: Synthetic polypeptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S IL15

SEQ ID NO: 788 - protein, 231 aa, Artificial Sequence; identical to SEQ ID NO: 64
  Description of Artificial Sequence: Synthetic polypeptide
  Fc chain of Chain 1 - 1C11[PD-1]_H3_IL15_N4D/N65D_(GGGGS)1 _Fc(216)_IgG1_pI(-)_Isosteric_A_C220S/PVA_/S267K/L368D/K370S

SEQ ID NO: 789 - protein, 5 aa, Artificial Sequence
  Description of Artificial Sequence: Synthetic peptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S vhCDR1
HYGMN

SEQ ID NO: 790 - protein, 17 aa, Artificial Sequence
  Description of Artificial Sequence: Synthetic peptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S vhCDR2
WINTYTGEPTYADGFTG

SEQ ID NO: 791 - protein, 8 aa, Artificial Sequence
  Description of Artificial Sequence: Synthetic peptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S vhCDR3
DYYGSSPY

SEQ ID NO: 792 - protein, 531 aa, Artificial Sequence
  Description of Artificial Sequence: Synthetic polypeptide
  Chain 2 - 1C11[PD-1]_H3_IL15Ralpha(sushi)_(GGGGS)1_Fc(216) _IgG1_C220S/PVA_/S267K/S364K/E357Q
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 793 - protein, 117 aa, Artificial Sequence; identical to SEQ ID NO: 192
  Description of Artificial Sequence: Synthetic polypeptide
  VH of Chain 2 - 1C11[PD-1]_H3_IL15Ralpha(sushi)_(GGGGS)1 _Fc(216)_IgG1_C220S/PVA_/S267K/S364K/E357Q

SEQ ID NO: 794 - protein, 65 aa, Artificial Sequence; identical to SEQ ID NO: 4
  Description of Artificial Sequence: Synthetic polypeptide
  Chain 2 - 1C11[PD-1]_H3_IL15Ralpha(sushi)_(GGGGS)1_Fc(216) _IgG1_C220S/PVA_/S267K/S364K/E357Q IL15Ralpha(sushi)

SEQ ID NO: 795 - protein, 231 aa, Artificial Sequence; identical to SEQ ID NO: 63
  Description of Artificial Sequence: Synthetic polypeptide
  Fc chain of Chain 2 - 1C11[PD-1]_H3_IL15Ralpha(sushi)_(GGGGS)1 _Fc(216)_IgG1_C220S/PVA_/S267K/S364K/E357Q

SEQ ID NO: 796 - protein, 5 aa, Artificial Sequence
  Description of Artificial Sequence: Synthetic peptide
  Chain 2 - 1C11[PD-1]_H3_IL15Ralpha(sushi)_(GGGGS)1_Fc(216) _IgG1_C220S/PVA_/S267K/S364K/E357Q vhCDR1
HYGMN

SEQ ID NO: 797 - protein, 17 aa, Artificial Sequence
  Description of Artificial Sequence: Synthetic peptide
  Chain 2 - 1C11[PD-1]_H3_IL15Ralpha(sushi)_(GGGGS)1_Fc(216) _IgG1_C220S/PVA_/S267K/S364K/E357Q vhCDR2
WINTYTGEPTYADGFTG

SEQ ID NO: 798 - protein, 8 aa, Artificial Sequence
  Description of Artificial Sequence: Synthetic peptide
  Chain 2 - 1C11[PD-1]_H3_IL15Ralpha(sushi)_(GGGGS)1_Fc(216) _IgG1_C220S/PVA_/S267K/S364K/E357Q vhCDR3
DYYGSSPY

SEQ ID NO: 799 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 800 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 801 - protein, 16 aa, Artificial Sequence
  Description of Artificial Sequence: Synthetic peptide
  Chain 3 - 1C11[PD-1]_L3 vhCDR1
KSSQSIVHSNGNTYLE

SEQ ID NO: 802 - protein, 7 aa, Artificial Sequence
  Description of Artificial Sequence: Synthetic peptide
  Chain 3 - 1C11[PD-1]_L3 vhCDR2
KVSNRFS

SEQ ID NO: 803 - protein, 9 aa, Artificial Sequence
  Description of Artificial Sequence: Synthetic peptide
  Chain 3 - 1C11[PD-1]_L3 vhCDR3
FQGSHVPNT

SEQ ID NO: 804 - protein, 665 aa, Artificial Sequence
  Description of Artificial Sequence: Synthetic polypeptide
  Chain 1 - 1C11[PD-1]_H3_IL15Ralpha(sushi) _(GGGGS)5-IL15(N4D/N65D)_IgG1_pI (-)_Isosteric_A_C220S/PVA_/S267K/L368D/K370S
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 805 - protein, 117 aa, Artificial Sequence; identical to SEQ ID NO: 192
  Description of Artificial Sequence: Synthetic polypeptide
  VH of Chain 1 - 1C11[PD-1]_H3_IL15Ralpha(sushi) _(GGGGS)5-IL15(N4D/N65D)_IgG1_pI (-)_Isosteric_A_C220S/PVA_/S267K/L368D/K370S

SEQ ID NO: 806 - protein, 65 aa, Artificial Sequence; identical to SEQ ID NO: 4
  Description of Artificial Sequence: Synthetic polypeptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S IL15Ralpha(sushi)

SEQ ID NO: 807 - protein, 114 aa, Artificial Sequence; identical to SEQ ID NO: 374
  Description of Artificial Sequence: Synthetic polypeptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S IL15

SEQ ID NO: 808 - protein, 231 aa, Artificial Sequence; identical to SEQ ID NO: 64
  Description of Artificial Sequence: Synthetic polypeptide
  Fc chain of Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S

SEQ ID NO: 809 - protein, 5 aa, Artificial Sequence
  Description of Artificial Sequence: Synthetic peptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S vhCDR1
HYGMN

SEQ ID NO: 810 - protein, 17 aa, Artificial Sequence
  Description of Artificial Sequence: Synthetic peptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S vhCDR2
WINTYTGEPTYADGFTG

SEQ ID NO: 811 - protein, 8 aa, Artificial Sequence
  Description of Artificial Sequence: Synthetic peptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S vhCDR3
DYYGSSPY

SEQ ID NO: 812 - protein, 446 aa, Artificial Sequence; identical to SEQ ID NO: 568
  Description of Artificial Sequence: Synthetic polypeptide
  Chain 2 - 1C11[PD-1]_H3_IgG1_C220S/PVA_/S267K/S364K/E357Q

SEQ ID NO: 813 - protein, 117 aa, Artificial Sequence; identical to SEQ ID NO: 192
  Description of Artificial Sequence: Synthetic polypeptide
  VH of Chain 2 - 1C11[PD-1]_H3_IgG1_C220S/PVA _/S267K/S364K/E357Q

SEQ ID NO: 814 - protein, 5 aa, Artificial Sequence
  Description of Artificial Sequence: Synthetic peptide
  Chain 2 - 1C11[PD-1]_H3_IgG1_C220S/PVA _/S267K/S364K/E357Q vhCDR1
HYGMN

SEQ ID NO: 815 - protein, 17 aa, Artificial Sequence
  Description of Artificial Sequence: Synthetic peptide
  Chain 2 - 1C11[PD-1]_H3_IgG1_C220S/PVA _/S267K/S364K/E357Q vhCDR2
WINTYTGEPTYADGFTG

SEQ ID NO: 816 - protein, 8 aa, Artificial Sequence
  Description of Artificial Sequence: Synthetic peptide
  Chain 2 - 1C11[PD-1]_H3_IgG1_C220S/PVA _/S267K/S364K/E357Q vhCDR3
DYYGSSPY

SEQ ID NO: 817 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 818 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 819 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 820 - protein, 7 aa, Artificial Sequence
  Description of Artificial Sequence: Synthetic peptide
  Chain 3 - 1C11[PD-1]_L3 vlCDR2
KVSNRFS

SEQ ID NO: 821 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 822 - protein, 446 aa, Artificial Sequence; identical to SEQ ID NO: 201
  Description of Artificial Sequence: Synthetic polypeptide
  XENP021575 1C11[PD-1]_H0L0_IgG1_PVA_/S267K Heavy Chain

SEQ ID NO: 823 - protein, 117 aa, Artificial Sequence; identical to SEQ ID NO: 202
  Description of Artificial Sequence: Synthetic polypeptide
  VH of XENP021575

SEQ ID NO: 824 - protein, 5 aa, Artificial Sequence
  Description of Artificial Sequence: Synthetic peptide
  XENP021575 vhCDR1
HYGMN

SEQ ID NO: 825 - protein, 17 aa, Artificial Sequence
  Description of Artificial Sequence: Synthetic peptide
  XENP021575 vhCDR2
WINTYTGEPTYADDFKG

SEQ ID NO: 826 - protein, 8 aa, Artificial Sequence
  Description of Artificial Sequence: Synthetic peptide
  XENP021575 vhCDR3
DYYGSSPY

SEQ ID NO: 827 - protein, 219 aa, Artificial Sequence; identical to SEQ ID NO: 206
  Description of Artificial Sequence: Synthetic polypeptide
  XENP021575 1C11[PD-1]_H0L0_IgG1_PVA_/S267K Light Chain

SEQ ID NO: 828 - protein, 112 aa, Artificial Sequence; identical to SEQ ID NO: 207
  Description of Artificial Sequence: Synthetic polypeptide
  VL of XENP021575

SEQ ID NO: 829 - protein, 16 aa, Artificial Sequence
  Description of Artificial Sequence: Synthetic peptide
  XENP021575 vlCDR1
RSSQSIVHSNGNTYLE

SEQ ID NO: 830 - protein, 7 aa, Artificial Sequence
  Description of Artificial Sequence: Synthetic peptide
  XENP021575 vlCDR2
KVSNRFS

SEQ ID NO: 831 - protein, 9 aa, Artificial Sequence
  Description of Artificial Sequence: Synthetic peptide
  XENP021575 vlCDR3
FQGSHVPNT

SEQ ID NO: 832 - protein, 446 aa, Artificial Sequence
  Description of Artificial Sequence: Synthetic polypeptide
  XENP022543 1C11[PD-1]_H1L1_IgG1_PVA_/S267K Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 833 - protein, 117 aa, Artificial Sequence
  Description of Artificial Sequence: Synthetic polypeptide
  VH of XENP022543
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSS

SEQ ID NO: 834 - protein, 5 aa, Artificial Sequence
  Description of Artificial Sequence: Synthetic peptide
  XENP022543 vhCDR1
HYGMN

SEQ ID NO: 835 - protein, 17 aa, Artificial Sequence
  Description of Artificial Sequence: Synthetic peptide
  XENP022543 vhCDR2
WINTYTGEPTYADKFQG

SEQ ID NO: 836 - protein, 8 aa, Artificial Sequence
  Description of Artificial Sequence: Synthetic peptide
  XENP022543 vhCDR3
DYYGSSPY

SEQ ID NO: 837 - protein, 219 aa, Artificial Sequence
  Description of Artificial Sequence: Synthetic polypeptide
  XENP022543 1C11[PD-1]_H1L1_IgG1_PVA_/S267K Light Chain
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 838 - protein, 112 aa, Artificial Sequence
  Description of Artificial Sequence: Synthetic polypeptide
  VL of XENP022543
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIK

SEQ ID NO: 839 - protein, 16 aa, Artificial Sequence
  Description of Artificial Sequence: Synthetic peptide
  XENP022543 vlCDR1
RSSQSIVHSNGNTYLE

SEQ ID NO: 840 - protein, 7 aa, Artificial Sequence
  Description of Artificial Sequence: Synthetic peptide
  XENP022543 vlCDR2
KVSNRFS

SEQ ID NO: 841 - protein, 9 aa, Artificial Sequence
  Description of Artificial Sequence: Synthetic peptide
  XENP022543 vlCDR3
FQGSHVPNT

SEQ ID NO: 842 - protein, 446 aa, Artificial Sequence
  Description of Artificial Sequence: Synthetic polypeptide
  XENP022544 1C11[PD-1]_H2L1_IgG1_PVA_/S267K Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 843 - protein, 117 aa, Artificial Sequence
  Description of Artificial Sequence: Synthetic polypeptide
  VH of XENP022544
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSS

SEQ ID NO: 844 - protein, 5 aa, Artificial Sequence
  Description of Artificial Sequence: Synthetic peptide
  XENP022544 vhCDR1
HYGMN

SEQ ID NO: 845 - protein, 17 aa, Artificial Sequence
  Description of Artificial Sequence: Synthetic peptide
  XENP022544 vhCDR2
WINTYTGEPTYADSVKG

SEQ ID NO: 846 - protein, 8 aa, Artificial Sequence
  Description of Artificial Sequence: Synthetic peptide
  XENP022544 vhCDR3
DYYGSSPY

SEQ ID NO: 847 - protein, 219 aa, Artificial Sequence; identical to SEQ ID NO: 837
  Description of Artificial Sequence: Synthetic polypeptide
  XENP022544 1C11[PD-1]_H2L1_IgG1_PVA_/S267K Light Chain

SEQ ID NO: 848 - protein, 112 aa, Artificial Sequence; identical to SEQ ID NO: 838
  Description of Artificial Sequence: Synthetic polypeptide
  VL of XENP022544

SEQ ID NO: 849 - protein, 16 aa, Artificial Sequence
  Description of Artificial Sequence: Synthetic peptide
  XENP022544 vlCDR1
RSSQSIVHSNGNTYLE

SEQ ID NO: 850 - protein, 7 aa, Artificial Sequence
  Description of Artificial Sequence: Synthetic peptide
  XENP022544 vlCDR2
KVSNRFS

SEQ ID NO: 851 - protein, 9 aa, Artificial Sequence
  Description of Artificial Sequence: Synthetic peptide
  XENP022544 vlCDR3
FQGSHVPNT

SEQ ID NO: 852 - protein, 446 aa, Artificial Sequence
  Description of Artificial Sequence: Synthetic polypeptide
  XENP022545 1C11[PD-1]_H3L1_IgG1_PVA_/S267K Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 853 - protein, 117 aa, Artificial Sequence; identical to SEQ ID NO: 192
  Description of Artificial Sequence: Synthetic polypeptide
  VH of XENP022545

SEQ ID NO: 854 - protein, 5 aa, Artificial Sequence
  Description of Artificial Sequence: Synthetic peptide
  XENP022545 vhCDR1
HYGMN

SEQ ID NO: 855 - protein, 17 aa, Artificial Sequence
  Description of Artificial Sequence: Synthetic peptide
  XENP022545 vhCDR2
WINTYTGEPTYADGFTG

SEQ ID NO: 856 - protein, 8 aa, Artificial Sequence
  Description of Artificial Sequence: Synthetic peptide
  XENP022545 vhCDR3
DYYGSSPY

SEQ ID NO: 857 - protein, 219 aa, Artificial Sequence; identical to SEQ ID NO: 837
  Description of Artificial Sequence: Synthetic polypeptide
  XENP022545 1C11[PD-1]_H3L1_IgG1_PVA_/S267K Light Chain

SEQ ID NO: 858 - protein, 112 aa, Artificial Sequence; identical to SEQ ID NO: 838
  Description of Artificial Sequence: Synthetic polypeptide
  VL of XENP022545

SEQ ID NO: 859 - protein, 16 aa, Artificial Sequence
  Description of Artificial Sequence: Synthetic peptide
  XENP022545 vlCDR1
RSSQSIVHSNGNTYLE

SEQ ID NO: 860 - protein, 7 aa, Artificial Sequence
  Description of Artificial Sequence: Synthetic peptide
  XENP022545 vlCDR2
KVSNRFS

SEQ ID NO: 861 - protein, 9 aa, Artificial Sequence
  Description of Artificial Sequence: Synthetic peptide
  XENP022545 vlCDR3
FQGSHVPNT

SEQ ID NO: 862 - protein, 446 aa, Artificial Sequence
  Description of Artificial Sequence: Synthetic polypeptide
  XENP022546 1C11[PD-1]_H4L1_IgG1_PVA_/S267K Heavy Chain
EVQLLESGGGLVQPGGSLRLSCAASGYTFTHYGMNWVRQAPGKGLEWVSWINTYTGEPTYADSVKGRFTISLDTSKSTAYLQMNSLRAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 863 - protein, 117 aa, Artificial Sequence
  Description of Artificial Sequence: Synthetic polypeptide
  VH of XENP022546
EVQLLESGGGLVQPGGSLRLSCAASGYTFTHYGMNWVRQAPGKGLEWVSWINTYTGEPTYADSVKGRFTISLDTSKSTAYLQMNSLRAEDTAVYYCARDYYGSSPYWGQGTLVTVSS

SEQ ID NO: 864 - protein, 5 aa, Artificial Sequence
  Description of Artificial Sequence: Synthetic peptide
  XENP022546 vhCDR1
HYGMN

SEQ ID NO: 865 - protein, 17 aa, Artificial Sequence
  Description of Artificial Sequence: Synthetic peptide
  XENP022546 vhCDR2
WINTYTGEPTYADSVKG

SEQ ID NO: 866 - protein, 8 aa, Artificial Sequence
  Description of Artificial Sequence: Synthetic peptide
  XENP022546 vhCDR3
DYYGSSPY

SEQ ID NO: 867 - protein, 219 aa, Artificial Sequence; identical to SEQ ID NO: 837
  Description of Artificial Sequence: Synthetic polypeptide
  XENP022546 1C11[PD-1]_H4L1_IgG1_PVA_/S267K Light Chain

SEQ ID NO: 868 - protein, 112 aa, Artificial Sequence; identical to SEQ ID NO: 838
  Description of Artificial Sequence: Synthetic polypeptide
  VL of XENP022546

SEQ ID NO: 869 - protein, 16 aa, Artificial Sequence
  Description of Artificial Sequence: Synthetic peptide
  XENP022546 vlCDR1
RSSQSIVHSNGNTYLE

SEQ ID NO: 870 - protein, 7 aa, Artificial Sequence
  Description of Artificial Sequence: Synthetic peptide
  XENP022546 vlCDR2
KVSNRFS

SEQ ID NO: 871 - protein, 9 aa, Artificial Sequence
  Description of Artificial Sequence: Synthetic peptide
  XENP022546 vlCDR3
FQGSHVPNT

SEQ ID NO: 872 - protein, 446 aa, Artificial Sequence; identical to SEQ ID NO: 832
  Description of Artificial Sequence: Synthetic polypeptide
  XENP022547 1C11[PD-1]_H1L2_IgG1_PVA_/S267K Heavy Chain

SEQ ID NO: 873 - protein, 117 aa, Artificial Sequence; identical to SEQ ID NO: 833
  Description of Artificial Sequence: Synthetic polypeptide
  VH of XENP022547

SEQ ID NO: 874 - protein, 5 aa, Artificial Sequence
  Description of Artificial Sequence: Synthetic peptide
  XENP022547 vhCDR1
HYGMN

SEQ ID NO: 875 - protein, 17 aa, Artificial Sequence
  Description of Artificial Sequence: Synthetic peptide
  XENP022547 vhCDR2
WINTYTGEPTYADKFQG

SEQ ID NO: 876 - protein, 8 aa, Artificial Sequence
  Description of Artificial Sequence: Synthetic peptide
  XENP022547 vhCDR3
DYYGSSPY

SEQ ID NO: 877 - protein, 219 aa, Artificial Sequence
  Description of Artificial Sequence: Synthetic polypeptide
  XENP022547 1C11[PD-1]_H1L2_IgG1_PVA_/S267K Light Chain
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 878 - protein, 112 aa, Artificial Sequence
  Description of Artificial Sequence: Synthetic polypeptide
  VL of XENP022547
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIK

SEQ ID NO: 879 - protein, 16 aa, Artificial Sequence
  Description of Artificial Sequence: Synthetic peptide
  XENP022547 vlCDR1
RSSQSIVHSNGNTYLE

SEQ ID NO: 880 - protein, 7 aa, Artificial Sequence
  Description of Artificial Sequence: Synthetic peptide
  XENP022547 vlCDR2
KVSNRFS

SEQ ID NO: 881 - protein, 9 aa, Artificial Sequence
  Description of Artificial Sequence: Synthetic peptide
  XENP022547 vlCDR3
FQGSHVPNT

SEQ ID NO: 882 - protein, 446 aa, Artificial Sequence; identical to SEQ ID NO: 842
  Description of Artificial Sequence: Synthetic polypeptide
  XENP022548 1C11[PD-1]_H2L2_IgG1_PVA_/S267K Heavy Chain

SEQ ID NO: 883 - protein, 117 aa, Artificial Sequence; identical to SEQ ID NO: 843
  Description of Artificial Sequence: Synthetic polypeptide
  VH of XENP022548

SEQ ID NO: 884 - protein, 5 aa, Artificial Sequence
  Description of Artificial Sequence: Synthetic peptide
  XENP022548 vhCDR1
HYGMN

SEQ ID NO: 885 - protein, 17 aa, Artificial Sequence
  Description of Artificial Sequence: Synthetic peptide
  XENP022548 vhCDR2
WINTYTGEPTYADSVKG

SEQ ID NO: 886 - protein, 8 aa, Artificial Sequence
  Description of Artificial Sequence: Synthetic peptide
  XENP022548 vhCDR3
DYYGSSPY

SEQ ID NO: 887 - protein, 219 aa, Artificial Sequence; identical to SEQ ID NO: 877
  Description of Artificial Sequence: Synthetic polypeptide
  XENP022548 1C11[PD-1]_H2L2_IgG1_PVA_/S267K Light Chain

SEQ ID NO: 888 - protein, 112 aa, Artificial Sequence; identical to SEQ ID NO: 878
  Description of Artificial Sequence: Synthetic polypeptide
  VL of XENP022548

SEQ ID NO: 889 - protein, 16 aa, Artificial Sequence
  Description of Artificial Sequence: Synthetic peptide
  XENP022548 vlCDR1
RSSQSIVHSNGNTYLE

SEQ ID NO: 890 - protein, 7 aa, Artificial Sequence
  Description of Artificial Sequence: Synthetic peptide
  XENP022548 vlCDR2
KVSNRFS

SEQ ID NO: 891 - protein, 9 aa, Artificial Sequence
  Description of Artificial Sequence: Synthetic peptide
  XENP022548 vlCDR3
FQGSHVPNT

SEQ ID NO: 892 - protein, 446 aa, Artificial Sequence; identical to SEQ ID NO: 852
  Description of Artificial Sequence: Synthetic polypeptide
  XENP022549 1C11[PD-1]_H3L2_IgG1_PVA_/S267K Heavy Chain

SEQ ID NO: 893 - protein, 117 aa, Artificial Sequence; identical to SEQ ID NO: 192
  Description of Artificial Sequence: Synthetic polypeptide
  VH of XENP022549

SEQ ID NO: 894 - protein, 5 aa, Artificial Sequence
  Description of Artificial Sequence: Synthetic peptide
  XENP022549 vhCDR1
HYGMN

SEQ ID NO: 895 - protein, 17 aa, Artificial Sequence
  Description of Artificial Sequence: Synthetic peptide
  XENP022549 vhCDR2
WINTYTGEPTYADGFTG

SEQ ID NO: 896 - protein, 8 aa, Artificial Sequence
  Description of Artificial Sequence: Synthetic peptide
  XENP022549 vhCDR3
DYYGSSPY

SEQ ID NO: 897 - protein, 219 aa, Artificial Sequence; identical to SEQ ID NO: 877
  Description of Artificial Sequence: Synthetic polypeptide
  XENP022549 1C11[PD-1]_H3L2_IgG1_PVA_/S267K Light Chain

SEQ ID NO: 898 - protein, 112 aa, Artificial Sequence; identical to SEQ ID NO: 878
  Description of Artificial Sequence: Synthetic polypeptide
  VL of XENP022549

SEQ ID NO: 899 - protein, 16 aa, Artificial Sequence
  Description of Artificial Sequence: Synthetic peptide
  XENP022549 vlCDR1
RSSQSIVHSNGNTYLE

SEQ ID NO: 900 - protein, 7 aa, Artificial Sequence
  Description of Artificial Sequence: Synthetic peptide
  XENP022549 vlCDR2
KVSNRFS

SEQ ID NO: 901 - protein, 9 aa, Artificial Sequence
  Description of Artificial Sequence: Synthetic peptide
  XENP022549 vlCDR3
FQGSHVPNT

SEQ ID NO: 902 - protein, 446 aa, Artificial Sequence; identical to SEQ ID NO: 862
  Description of Artificial Sequence: Synthetic polypeptide
  XENP022550 1C11[PD-1]_H4L2_IgG1_PVA_/S267K Heavy Chain

SEQ ID NO: 903 - protein, 117 aa, Artificial Sequence; identical to SEQ ID NO: 863
  Description of Artificial Sequence: Synthetic polypeptide
  VH of XENP022550

SEQ ID NO: 904 - protein, 5 aa, Artificial Sequence
  Description of Artificial Sequence: Synthetic peptide
  XENP022550 vhCDR1
HYGMN

SEQ ID NO: 905 - protein, 17 aa, Artificial Sequence
  Description of Artificial Sequence: Synthetic peptide
  XENP022550 vhCDR2
WINTYTGEPTYADSVKG

SEQ ID NO: 906 - protein, 8 aa, Artificial Sequence
  Description of Artificial Sequence: Synthetic peptide
  XENP022550 vhCDR3
DYYGSSPY

SEQ ID NO: 907 - protein, 219 aa, Artificial Sequence; identical to SEQ ID NO: 877
  Description of Artificial Sequence: Synthetic polypeptide
  XENP022550 1C11[PD-1]_H4L2_IgG1_PVA_/S267K Light Chain

SEQ ID NO: 908 - protein, 112 aa, Artificial Sequence; identical to SEQ ID NO: 878
  Description of Artificial Sequence: Synthetic polypeptide
  VL of XENP022550

SEQ ID NO: 909 - protein, 16 aa, Artificial Sequence
  Description of Artificial Sequence: Synthetic peptide
  XENP022550 vlCDR1
RSSQSIVHSNGNTYLE

SEQ ID NO: 910 - protein, 7 aa, Artificial Sequence
  Description of Artificial Sequence: Synthetic peptide
  XENP022550 vlCDR2
KVSNRFS

SEQ ID NO: 911 - protein, 9 aa, Artificial Sequence
  Description of Artificial Sequence: Synthetic peptide
  XENP022550 vlCDR3
FQGSHVPNT

SEQ ID NO: 912 - protein, 446 aa, Artificial Sequence; identical to SEQ ID NO: 832
  Description of Artificial Sequence: Synthetic polypeptide
  XENP022551 1C11[PD-1]_H1L3_IgG1_PVA_/S267K Heavy Chain

SEQ ID NO: 913 - protein, 117 aa, Artificial Sequence; identical to SEQ ID NO: 833
  Description of Artificial Sequence: Synthetic polypeptide
  VH of XENP022551

SEQ ID NO: 914 - protein, 5 aa, Artificial Sequence
  Description of Artificial Sequence: Synthetic peptide
  XENP022551 vhCDR1
HYGMN

SEQ ID NO: 915 - protein, 17 aa, Artificial Sequence
  Description of Artificial Sequence: Synthetic peptide
  XENP022551 vhCDR2
WINTYTGEPTYADKFQG

SEQ ID NO: 916 - protein, 8 aa, Artificial Sequence
  Description of Artificial Sequence: Synthetic peptide
  XENP022551 vhCDR3
DYYGSSPY

SEQ ID NO: 917 - protein, 219 aa, Artificial Sequence; identical to SEQ ID NO: 216
  Description of Artificial Sequence: Synthetic polypeptide
  XENP022551 1C11[PD-1]_H1L3_IgG1_PVA_/S267K Light Chain

SEQ ID NO: 918 - protein, 112 aa, Artificial Sequence; identical to SEQ ID NO: 196
  Description of Artificial Sequence: Synthetic polypeptide
  VL of XENP022551

SEQ ID NO: 919 - protein, 16 aa, Artificial Sequence
  Description of Artificial Sequence: Synthetic peptide
  XENP022551 vlCDR1
KSSQSIVHSNGNTYLE

SEQ ID NO: 920 - protein, 7 aa, Artificial Sequence
  Description of Artificial Sequence: Synthetic peptide
  XENP022551 vlCDR2
KVSNRFS

SEQ ID NO: 921 - protein, 9 aa, Artificial Sequence
  Description of Artificial Sequence: Synthetic peptide
  XENP022551 vlCDR3
FQGSHVPNT

SEQ ID NO: 922 - protein, 446 aa, Artificial Sequence; identical to SEQ ID NO: 842
  Description of Artificial Sequence: Synthetic polypeptide
  XENP022552 1C11[PD-1]_H2L3_IgG1_PVA_/S267K Heavy Chain

SEQ ID NO: 923 - protein, 117 aa, Artificial Sequence; identical to SEQ ID NO: 843
  Description of Artificial Sequence: Synthetic polypeptide
  VH of XENP022552

SEQ ID NO: 924 - protein, 5 aa, Artificial Sequence
  Description of Artificial Sequence: Synthetic peptide
  XENP022552 vhCDR1
HYGMN

SEQ ID NO: 925 - protein, 17 aa, Artificial Sequence
  Description of Artificial Sequence: Synthetic peptide
  XENP022552 vhCDR2
WINTYTGEPTYADSVKG

SEQ ID NO: 926 - protein, 8 aa, Artificial Sequence
  Description of Artificial Sequence: Synthetic peptide
  XENP022552 vhCDR3
DYYGSSPY

SEQ ID NO: 927 - protein, 219 aa, Artificial Sequence; identical to SEQ ID NO: 216
  Description of Artificial Sequence: Synthetic polypeptide
  XENP022552 1C11[PD-1]_H2L3_IgG1_PVA_/S267K Light Chain

SEQ ID NO: 928 - protein, 112 aa, Artificial Sequence; identical to SEQ ID NO: 196
  Description of Artificial Sequence: Synthetic polypeptide
  VL of XENP022552

SEQ ID NO: 929 - protein, 16 aa, Artificial Sequence
  Description of Artificial Sequence: Synthetic peptide
  XENP022552 vlCDR1
KSSQSIVHSNGNTYLE

SEQ ID NO: 930 - protein, 7 aa, Artificial Sequence
  Description of Artificial Sequence: Synthetic peptide
  XENP022552 vlCDR2
KVSNRFS

SEQ ID NO: 931 - protein, 9 aa, Artificial Sequence
  Description of Artificial Sequence: Synthetic peptide
  XENP022552 vlCDR3
FQGSHVPNT

SEQ ID NO: 932 - protein, 446 aa, Artificial Sequence; identical to SEQ ID NO: 852
  Description of Artificial Sequence: Synthetic polypeptide
  XENP022553 1C11[PD-1]_H3L3_IgG1_PVA_/S267K Heavy Chain

SEQ ID NO: 933 - protein, 117 aa, Artificial Sequence; identical to SEQ ID NO: 192
  Description of Artificial Sequence: Synthetic polypeptide
  VH of XENP022553

SEQ ID NO: 934 - protein, 5 aa, Artificial Sequence
  Description of Artificial Sequence: Synthetic peptide
  XENP022553 vhCDR1
HYGMN

SEQ ID NO: 935 - protein, 17 aa, Artificial Sequence
  Description of Artificial Sequence: Synthetic peptide
  XENP022553 vhCDR2
WINTYTGEPTYADGFTG

SEQ ID NO: 936 - protein, 8 aa, Artificial Sequence
  Description of Artificial Sequence: Synthetic peptide
  XENP022553 vhCDR3
DYYGSSPY

SEQ ID NO: 937 - protein, 219 aa, Artificial Sequence; identical to SEQ ID NO: 216
  Description of Artificial Sequence: Synthetic polypeptide
  XENP022553 1C11[PD-1]_H3L3_IgG1_PVA_/S267K Light Chain

SEQ ID NO: 938 - protein, 112 aa, Artificial Sequence; identical to SEQ ID NO: 196
  Description of Artificial Sequence: Synthetic polypeptide
  VL of XENP022553

SEQ ID NO: 939 - protein, 16 aa, Artificial Sequence
  Description of Artificial Sequence: Synthetic peptide
  XENP022553 vlCDR1
KSSQSIVHSNGNTYLE

SEQ ID NO: 940 - protein, 7 aa, Artificial Sequence
  Description of Artificial Sequence: Synthetic peptide
  XENP022553 vlCDR2
KVSNRFS

SEQ ID NO: 941 - protein, 9 aa, Artificial Sequence
  Description of Artificial Sequence: Synthetic peptide
  XENP022553 vlCDR3
FQGSHVPNT

SEQ ID NO: 942 - protein, 446 aa, Artificial Sequence; identical to SEQ ID NO: 862
  Description of Artificial Sequence: Synthetic polypeptide
  XENP022554 1C11[PD-1]_H4L3_IgG1_PVA_/S267K Heavy Chain

SEQ ID NO: 943 - protein, 117 aa, Artificial Sequence; identical to SEQ ID NO: 863
  Description of Artificial Sequence: Synthetic polypeptide
  VH of XENP022554

SEQ ID NO: 944 - protein, 5 aa, Artificial Sequence
  Description of Artificial Sequence: Synthetic peptide
  XENP022554 vhCDR1
HYGMN

SEQ ID NO: 945 - protein, 17 aa, Artificial Sequence
  Description of Artificial Sequence: Synthetic peptide
  XENP022554 vhCDR2
WINTYTGEPTYADSVKG

SEQ ID NO: 946 - protein, 8 aa, Artificial Sequence
  Description of Artificial Sequence: Synthetic peptide
  XENP022554 vhCDR3
DYYGSSPY

SEQ ID NO: 947 - protein, 219 aa, Artificial Sequence; identical to SEQ ID NO: 216
  Description of Artificial Sequence: Synthetic polypeptide
  XENP022554 1C11[PD-1]_H4L3_IgG1_PVA_/S267K Light Chain

SEQ ID NO: 948 - protein, 112 aa, Artificial Sequence; identical to SEQ ID NO: 196
  Description of Artificial Sequence: Synthetic polypeptide
  VL of XENP022554

SEQ ID NO: 949 - protein, 16 aa, Artificial Sequence
  Description of Artificial Sequence: Synthetic peptide
  XENP022554 vlCDR1
KSSQSIVHSNGNTYLE

SEQ ID NO: 950 - protein, 7 aa, Artificial Sequence
  Description of Artificial Sequence: Synthetic peptide
  XENP022554 vlCDR2
KVSNRFS

SEQ ID NO: 951 - protein, 9 aa, Artificial Sequence
  Description of Artificial Sequence: Synthetic peptide
  XENP022554 vlCDR3
FQGSHVPNT

SEQ ID NO: 952 - protein, 440 aa, Artificial Sequence; identical to SEQ ID NO: 233
  Description of Artificial Sequence: Synthetic polypeptide
  XENP021480 Chain 1 - human_IL15Ralpha(sushi)_(GGGGS)6-human _IL15(single-chain)_IgG1_pI(-)_Isosteric_A_C220S/PVA _/S267K/L368D/K370S

SEQ ID NO: 953 - protein, 65 aa, Artificial Sequence; identical to SEQ ID NO: 4
  Description of Artificial Sequence: Synthetic polypeptide
  XENP021480 human IL15Ralpha(sushi)

SEQ ID NO: 954 - protein, 114 aa, Artificial Sequence; identical to SEQ ID NO: 2
  Description of Artificial Sequence: Synthetic polypeptide
  XENP021480 human IL15

SEQ ID NO: 955 - protein, 231 aa, Artificial Sequence; identical to SEQ ID NO: 64
  Description of Artificial Sequence: Synthetic polypeptide
  Fc chain of XENP021480

SEQ ID NO: 956 - protein, 480 aa, Artificial Sequence; identical to SEQ ID NO: 516
  Description of Artificial Sequence: Synthetic polypeptide
  XENP021480 Chain 2  - 1G6_L1.194_H1.279_scFv(GKPGS)4_IgG1 _C220S/PVA_/S267K/S364K/E357Q

SEQ ID NO: 957 - protein, 107 aa, Artificial Sequence; identical to SEQ ID NO: 132
  Description of Artificial Sequence: Synthetic polypeptide
  VL of XENP021480

SEQ ID NO: 958 - protein, 122 aa, Artificial Sequence; identical to SEQ ID NO: 127
  Description of Artificial Sequence: Synthetic polypeptide
  VH of XENP021480

SEQ ID NO: 959 - protein, 231 aa, Artificial Sequence; identical to SEQ ID NO: 63
  Description of Artificial Sequence: Synthetic polypeptide
  Fc chain of XENP021480

SEQ ID NO: 960 - protein, 11 aa, Artificial Sequence
  Description of Artificial Sequence: Synthetic peptide
  XENP021480 vlCDR1
RASQSVGNDVA

SEQ ID NO: 961 - protein, 7 aa, Artificial Sequence
  Description of Artificial Sequence: Synthetic peptide
  XENP021480 vlCDR2
YASHRYT

SEQ ID NO: 962 - protein, 9 aa, Artificial Sequence
  Description of Artificial Sequence: Synthetic peptide
  XENP021480 vlCDR3
QQDFSSPRT

SEQ ID NO: 963 - protein, 5 aa, Artificial Sequence
  Description of Artificial Sequence: Synthetic peptide
  XENP021480 vhCDR1
NYWMN

SEQ ID NO: 964 - protein, 19 aa, Artificial Sequence
  Description of Artificial Sequence: Synthetic peptide
  XENP021480 vhCDR2
EIRLYSNNYATHYAESVKG

SEQ ID NO: 965 - protein, 11 aa, Artificial Sequence
  Description of Artificial Sequence: Synthetic peptide
  XENP021480 vhCDR3
YYGNYGGYFDV

SEQ ID NO: 966 - protein, 480 aa, Artificial Sequence; identical to SEQ ID NO: 526
  Description of Artificial Sequence: Synthetic polypeptide
  Chain 1 - 1G6_L1.194_H1.279_scFv(GKPGS)4_ Fc(216)_IgG1_pI(-) _Isosteric_A_C220S/PVA_/S267K/L368D/K370S

SEQ ID NO: 967 - protein, 107 aa, Artificial Sequence; identical to SEQ ID NO: 132
  Description of Artificial Sequence: Synthetic polypeptide
  VL of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 968 - protein, 122 aa, Artificial Sequence; identical to SEQ ID NO: 127
  Description of Artificial Sequence: Synthetic polypeptide
  VH of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 969 - protein, 231 aa, Artificial Sequence; identical to SEQ ID NO: 64
  Description of Artificial Sequence: Synthetic polypeptide
  Fc chain of Chain 1 - 1G6_L1.194_H1.279_scFv(GKPGS)4_ Fc(216) _IgG1_pI(-)_Isosteric_A_C220S/PVA_/S267K/L368D/K370S

SEQ ID NO: 970 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR1
RASQSVGNDVA

SEQ ID NO: 971 - protein, 7 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR2
YASHRYT

SEQ ID NO: 972 - protein, 9 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR3
QQDFSSPRT

SEQ ID NO: 973 - protein, 5 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR1
NYWMN

SEQ ID NO: 974 - protein, 19 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR2
EIRLYSNNYATHYAESVKG

SEQ ID NO: 975 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR3
YYGNYGGYFDV

SEQ ID NO: 976 - protein, 326 aa, Artificial Sequence; identical to SEQ ID NO: 536
  Description of Artificial Sequence: Synthetic polypeptide
  Chain 2 - human_IL15Ralpha(sushi)_(GGGGS)6_ Fc(216)_IgG1 _C220S/PVA_/S267K/S364K/E357Q

SEQ ID NO: 977 - protein, 65 aa, Artificial Sequence; identical to SEQ ID NO: 4
  Description of Artificial Sequence: Synthetic polypeptide
  Chain 2 - human_IL15Ralpha(sushi)_(GGGGS)6_ Fc(216)_IgG1 _C220S/PVA_/S267K/S364K/E357Q human IL15Ralpha(sushi)

SEQ ID NO: 978 - protein, 231 aa, Artificial Sequence; identical to SEQ ID NO: 63
  Description of Artificial Sequence: Synthetic polypeptide
  Fc chain of Chain 2 - human_IL15Ralpha(sushi)_(GGGGS)6 _ Fc(216)_IgG1_C220S/PVA_/S267K/S364K/E357Q

SEQ ID NO: 979 - protein, 114 aa, Artificial Sequence; identical to SEQ ID NO: 2
  Description of Artificial Sequence: Synthetic polypeptide
  Chain 3 - IL-15

SEQ ID NO: 980 - protein, 480 aa, Artificial Sequence; identical to SEQ ID NO: 526
  Description of Artificial Sequence: Synthetic polypeptide
  Chain 1 - 1G6_L1.194_H1.279_scFv(GKPGS)4_ Fc(216)_IgG1_pI(-) _Isosteric_A_C220S/PVA_/S267K/L368D/K370S

SEQ ID NO: 981 - protein, 107 aa, Artificial Sequence; identical to SEQ ID NO: 132
  Description of Artificial Sequence: Synthetic polypeptide
  VL of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 982 - protein, 122 aa, Artificial Sequence; identical to SEQ ID NO: 127
  Description of Artificial Sequence: Synthetic polypeptide
  VH of Chain 1 - 1G6_L1.194_H1.279_scFv(GKPGS)4_ Fc(216)_IgG1 _pI(-)_Isosteric_A_C220S/PVA_/S267K/L368D/K370S

SEQ ID NO: 983 - protein, 231 aa, Artificial Sequence; identical to SEQ ID NO: 64
  Description of Artificial Sequence: Synthetic polypeptide
  Fc chain of Chain 1 - 1G6_L1.194_H1.279_scFv(GKPGS)4_ Fc(216) _IgG1_pI(-)_Isosteric_A_C220S/PVA_/S267K/L368D/K370S

SEQ ID NO: 984 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR1
RASQSVGNDVA

SEQ ID NO: 985 - protein, 7 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR2
YASHRYT

SEQ ID NO: 986 - protein, 9 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vlCDR3
QQDFSSPRT

SEQ ID NO: 987 - protein, 5 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR1
NYWMN

SEQ ID NO: 988 - protein, 19 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR2
EIRLYSNNYATHYAESVKG

SEQ ID NO: 989 - protein, 11 aa, Artificial Sequence
  Description of Artificial Sequence: Synthetic peptide
  Chain 1 - 1G6_L1.194_H1.279_scFv(GKPGS)4_ Fc(216)_IgG1_pI(-) _Isosteric_A_C220S/PVA_/S267K/L368D/K370S vhCDR3
YYGNYGGYFDV

SEQ ID NO: 990 - protein, 299 aa, Artificial Sequence; identical to SEQ ID NO: 330
  Description of Artificial Sequence: Synthetic polypeptide
  Chain 2 - human_IL15Ralpha(sushi-D96/C97/A98)_ Fc(216)_IgG1 _C220S/PVA_/S267K/S364K/E357Q

SEQ ID NO: 991 - protein, 68 aa, Artificial Sequence; identical to SEQ ID NO: 284
  Description of Artificial Sequence: Synthetic polypeptide
  Chain 2 - human_IL15Ralpha(sushi-D96/C97/A98)_ Fc(216)_IgG1 _C220S/PVA_/S267K/S364K/E357Q human IL15Ralpha(sushi)

SEQ ID NO: 992 - protein, 231 aa, Artificial Sequence; identical to SEQ ID NO: 63
  Description of Artificial Sequence: Synthetic polypeptide
  Fc chain of Chain 2 - human_IL15Ralpha(sushi-D96/C97/A98) _ Fc(216)_IgG1_C220S/PVA_/S267K/S364K/E357Q

SEQ ID NO: 993 - protein, 114 aa, Artificial Sequence; identical to SEQ ID NO: 274
  Description of Artificial Sequence: Synthetic polypeptide
  Chain 3 - IL-15(E87C)

SEQ ID NO: 994 - protein, 440 aa, Artificial Sequence; identical to SEQ ID NO: 233
  Description of Artificial Sequence: Synthetic polypeptide
  XENP022022 Chain 1 - human_IL15Ralpha(sushi)_(GGGGS)6-human _IL15(single-chain)_ IgG1_pI(-)_Isosteric_A_/PVA _/S267K/L368D/K370S

SEQ ID NO: 995 - protein, 65 aa, Artificial Sequence; identical to SEQ ID NO: 4
  Description of Artificial Sequence: Synthetic polypeptide
  XENP022022 human IL15Ralpha(sushi)

SEQ ID NO: 996 - protein, 114 aa, Artificial Sequence; identical to SEQ ID NO: 2
  Description of Artificial Sequence: Synthetic polypeptide
  XENP022022 human IL15

SEQ ID NO: 997 - protein, 231 aa, Artificial Sequence; identical to SEQ ID NO: 64
  Description of Artificial Sequence: Synthetic polypeptide
  Fc chain of XENP022022

SEQ ID NO: 998 - protein, 451 aa, Artificial Sequence; identical to SEQ ID NO: 558
  Description of Artificial Sequence: Synthetic polypeptide
  XENP022022 Chain 2 - 1G6_H1.278 [PD-1]_IgG1_C220S/PVA _/S267K/S364K/E357Q

SEQ ID NO: 999 - protein, 122 aa, Artificial Sequence; identical to SEQ ID NO: 559
  Description of Artificial Sequence: Synthetic polypeptide
  VH of XENP022022

SEQ ID NO: 1000 - protein, 5 aa, Artificial Sequence
  Description of Artificial Sequence: Synthetic peptide
  XENP022022 vhCDR1
NYWMN

SEQ ID NO: 1001 - protein, 19 aa, Artificial Sequence
  Description of Artificial Sequence: Synthetic peptide
  XENP022022 vhCDR2
EIRLYSNNYATHYAESVKG

SEQ ID NO: 1002 - protein, 11 aa, Artificial Sequence
  Description of Artificial Sequence: Synthetic peptide
  XENP022022 vhCDR3
YYGNYGGYFDV

SEQ ID NO: 1003 - protein, 214 aa, Artificial Sequence; identical to SEQ ID NO: 563
  Description of Artificial Sequence: Synthetic polypeptide
  XENP022022 Chain 3 - 1G6_L1.188[PD-1]

SEQ ID NO: 1004 - protein, 107 aa, Artificial Sequence; identical to SEQ ID NO: 564
  Description of Artificial Sequence: Synthetic polypeptide
  VL of XENP022022

SEQ ID NO: 1005 - protein, 11 aa, Artificial Sequence
  Description of Artificial Sequence: Synthetic peptide
  XENP022022 vlCDR1
RASQSVGNDVA

SEQ ID NO: 1006 - protein, 7 aa, Artificial Sequence
  Description of Artificial Sequence: Synthetic peptide
  XENP022022 vlCDR2
YASHRYT

SEQ ID NO: 1007 - protein, 9 aa, Artificial Sequence
  Description of Artificial Sequence: Synthetic peptide
  XENP022022 vlCDR3
QQDFSSPRT

SEQ ID NO: 1008 - protein, 446 aa, Artificial Sequence; identical to SEQ ID NO: 568
  Description of Artificial Sequence: Synthetic polypeptide
  XENP025849 Chain 1 - 1C11[PD-1]_H3_ IgG1_PVA _/S267K/S364K/E357Q

SEQ ID NO: 1009 - protein, 117 aa, Artificial Sequence; identical to SEQ ID NO: 192
  Description of Artificial Sequence: Synthetic polypeptide
  VH of XENP025849

SEQ ID NO: 1010 - protein, 5 aa, Artificial Sequence
  Description of Artificial Sequence: Synthetic peptide
  XENP025849 vhCDR1
HYGMN

SEQ ID NO: 1011 - protein, 17 aa, Artificial Sequence
  Description of Artificial Sequence: Synthetic peptide
  XENP025849 vhCDR2
WINTYTGEPTYADGFTG

SEQ ID NO: 1012 - protein, 8 aa, Artificial Sequence
  Description of Artificial Sequence: Synthetic peptide
  XENP025849 vhCDR3
DYYGSSPY

SEQ ID NO: 1013 - protein, 435 aa, Artificial Sequence; identical to SEQ ID NO: 573
  Description of Artificial Sequence: Synthetic polypeptide
  XENP025849 Chain 2 - human_IL15Ralpha(sushi)_(GGGGS)5-human _IL15(single-chain)_Fc(216)_IgG1_pI (-)_Isosteric_A_C220S/PVA_/S267K/L368D/K370S

SEQ ID NO: 1014 - protein, 65 aa, Artificial Sequence; identical to SEQ ID NO: 4
  Description of Artificial Sequence: Synthetic polypeptide
  XENP025849 human IL15Ralpha(sushi)

SEQ ID NO: 1015 - protein, 114 aa, Artificial Sequence; identical to SEQ ID NO: 2
  Description of Artificial Sequence: Synthetic polypeptide
  XENP025849 human IL15

SEQ ID NO: 1016 - protein, 231 aa, Artificial Sequence; identical to SEQ ID NO: 64
  Description of Artificial Sequence: Synthetic polypeptide
  Fc chain of XENP025849

SEQ ID NO: 1017 - protein, 219 aa, Artificial Sequence; identical to SEQ ID NO: 216
  Description of Artificial Sequence: Synthetic polypeptide
  XENP025849 Chain 3 - 1C11[PD-1]_L3

SEQ ID NO: 1018 - protein, 112 aa, Artificial Sequence; identical to SEQ ID NO: 196
  Description of Artificial Sequence: Synthetic polypeptide
  VL of XENP025849

SEQ ID NO: 1019 - protein, 16 aa, Artificial Sequence
  Description of Artificial Sequence: Synthetic peptide
  XENP025849 vlCDR1
KSSQSIVHSNGNTYLE

SEQ ID NO: 1020 - protein, 7 aa, Artificial Sequence
  Description of Artificial Sequence: Synthetic peptide
  XENP025849 vlCDR2
KVSNRFS

SEQ ID NO: 1021 - protein, 9 aa, Artificial Sequence
  Description of Artificial Sequence: Synthetic peptide
  XENP025849 vlCDR3
FQGSHVPNT

SEQ ID NO: 1022 - protein, 446 aa, Artificial Sequence; identical to SEQ ID NO: 568
  Description of Artificial Sequence: Synthetic polypeptide
  XENP024535 Chain 1 - 1C11[PD-1]_H3_ IgG1_PVA _/S267K/S364K/E357Q

SEQ ID NO: 1023 - protein, 117 aa, Artificial Sequence; identical to SEQ ID NO: 192
  Description of Artificial Sequence: Synthetic polypeptide
  VH of XENP024535

SEQ ID NO: 1024 - protein, 5 aa, Artificial Sequence
  Description of Artificial Sequence: Synthetic peptide
  XENP024535 vhCDR1
HYGMN

SEQ ID NO: 1025 - protein, 17 aa, Artificial Sequence
  Description of Artificial Sequence: Synthetic peptide
  XENP024535 vhCDR2
WINTYTGEPTYADGFTG

SEQ ID NO: 1026 - protein, 8 aa, Artificial Sequence
  Description of Artificial Sequence: Synthetic peptide
  XENP024535 vhCDR3
DYYGSSPY

SEQ ID NO: 1027 - protein, 435 aa, Artificial Sequence; identical to SEQ ID NO: 587
  Description of Artificial Sequence: Synthetic polypeptide
  XENP024535 Chain 2 - human_IL15Ralpha(sushi)_(GGGGS)5-human _IL15(N65D;single-chain)_ Fc(216)_IgG1_pI (-)_Isosteric_A_C220S/PVA_/S267K/L368D/K370S

SEQ ID NO: 1028 - protein, 65 aa, Artificial Sequence; identical to SEQ ID NO: 4
  Description of Artificial Sequence: Synthetic polypeptide
  XENP024535 human IL15Ralpha(sushi)

SEQ ID NO: 1029 - protein, 114 aa, Artificial Sequence; identical to SEQ ID NO: 358
  Description of Artificial Sequence: Synthetic polypeptide
  XENP024535 human IL15

SEQ ID NO: 1030 - protein, 231 aa, Artificial Sequence; identical to SEQ ID NO: 64
  Description of Artificial Sequence: Synthetic polypeptide
  Fc chain of XENP024535

SEQ ID NO: 1031 - protein, 219 aa, Artificial Sequence; identical to SEQ ID NO: 216
  Description of Artificial Sequence: Synthetic polypeptide
  XENP024535 Chain 3 - 1C11[PD-1]_L3

SEQ ID NO: 1032 - protein, 112 aa, Artificial Sequence; identical to SEQ ID NO: 196
  Description of Artificial Sequence: Synthetic polypeptide
  VL of XENP024535

SEQ ID NO: 1033 - protein, 16 aa, Artificial Sequence
  Description of Artificial Sequence: Synthetic peptide
  XENP024535 vlCDR1
KSSQSIVHSNGNTYLE

SEQ ID NO: 1034 - protein, 7 aa, Artificial Sequence
  Description of Artificial Sequence: Synthetic peptide
  XENP024535 vlCDR2
KVSNRFS

SEQ ID NO: 1035 - protein, 9 aa, Artificial Sequence
  Description of Artificial Sequence: Synthetic peptide
  XENP024535 vlCDR3
FQGSHVPNT

SEQ ID NO: 1036 - protein, 446 aa, Artificial Sequence; identical to SEQ ID NO: 568
  Description of Artificial Sequence: Synthetic polypeptide
  XENP024536 Chain 1 - 1C11[PD-1]_H3_ IgG1_PVA _/S267K/S364K/E357Q

SEQ ID NO: 1037 - protein, 117 aa, Artificial Sequence; identical to SEQ ID NO: 192
  Description of Artificial Sequence: Synthetic polypeptide
  VH of XENP024536

SEQ ID NO: 1038 - protein, 5 aa, Artificial Sequence
  Description of Artificial Sequence: Synthetic peptide
  XENP024536 vhCDR1
HYGMN

SEQ ID NO: 1039 - protein, 17 aa, Artificial Sequence
  Description of Artificial Sequence: Synthetic peptide
  XENP024536 vhCDR2
WINTYTGEPTYADGFTG

SEQ ID NO: 1040 - protein, 8 aa, Artificial Sequence
  Description of Artificial Sequence: Synthetic peptide
  XENP024536 vhCDR3
DYYGSSPY

SEQ ID NO: 1041 - protein, 435 aa, Artificial Sequence; identical to SEQ ID NO: 442
  Description of Artificial Sequence: Synthetic polypeptide
  XENP024536 Chain 2 - human_IL15Ralpha(sushi)_(GGGGS)5-human _IL15(Q108E;single-chain)_ Fc(216)_IgG1_pI (-)_Isosteric_A_C220S/PVA_/S267K/L368D/K370S

SEQ ID NO: 1042 - protein, 65 aa, Artificial Sequence; identical to SEQ ID NO: 4
  Description of Artificial Sequence: Synthetic polypeptide
  XENP024536 human IL15Ralpha(sushi)

SEQ ID NO: 1043 - protein, 114 aa, Artificial Sequence; identical to SEQ ID NO: 359
  Description of Artificial Sequence: Synthetic polypeptide
  XENP024536 human IL15

SEQ ID NO: 1044 - protein, 231 aa, Artificial Sequence; identical to SEQ ID NO: 64
  Description of Artificial Sequence: Synthetic polypeptide
  Fc chain of XENP024536

SEQ ID NO: 1045 - protein, 219 aa, Artificial Sequence; identical to SEQ ID NO: 216
  Description of Artificial Sequence: Synthetic polypeptide
  XENP024536 Chain 3 - 1C11[PD-1]_L3

SEQ ID NO: 1046 - protein, 112 aa, Artificial Sequence; identical to SEQ ID NO: 196
  Description of Artificial Sequence: Synthetic polypeptide
  VL of XENP024536

SEQ ID NO: 1047 - protein, 16 aa, Artificial Sequence
  Description of Artificial Sequence: Synthetic peptide
  XENP024536 vlCDR1
KSSQSIVHSNGNTYLE

SEQ ID NO: 1048 - protein, 7 aa, Artificial Sequence
  Description of Artificial Sequence: Synthetic peptide
  XENP024536 vlCDR2
KVSNRFS

SEQ ID NO: 1049 - protein, 9 aa, Artificial Sequence
  Description of Artificial Sequence: Synthetic peptide
  XENP024536 vlCDR3
FQGSHVPNT

SEQ ID NO: 1050 - protein, 446 aa, Artificial Sequence; identical to SEQ ID NO: 568
  Description of Artificial Sequence: Synthetic polypeptide
  XENP025850 Chain 1 - 1C11[PD-1]_H3L3_ IgG1_PVA _/S267K/S364K/E357Q

SEQ ID NO: 1051 - protein, 117 aa, Artificial Sequence; identical to SEQ ID NO: 192
  Description of Artificial Sequence: Synthetic polypeptide
  VH of XENP025850

SEQ ID NO: 1052 - protein, 5 aa, Artificial Sequence
  Description of Artificial Sequence: Synthetic peptide
  XENP025850 vhCDR1
HYGMN

SEQ ID NO: 1053 - protein, 17 aa, Artificial Sequence
  Description of Artificial Sequence: Synthetic peptide
  XENP025850 vhCDR2
WINTYTGEPTYADGFTG

SEQ ID NO: 1054 - protein, 8 aa, Artificial Sequence
  Description of Artificial Sequence: Synthetic peptide
  XENP025850 vhCDR3
DYYGSSPY

SEQ ID NO: 1055 - protein, 435 aa, Artificial Sequence; identical to SEQ ID NO: 447
  Description of Artificial Sequence: Synthetic polypeptide
  XENP025850 Chain 2 - human_IL15Ralpha(sushi)_(GGGGS)5-human _IL15(N4D/N65D;single-chain)_ Fc(216)_IgG1_pI (-)_Isosteric_A_C220S/PVA_/S267K/L368D/K370S

SEQ ID NO: 1056 - protein, 65 aa, Artificial Sequence; identical to SEQ ID NO: 4
  Description of Artificial Sequence: Synthetic polypeptide
  XENP025850 human IL15Ralpha(sushi)

SEQ ID NO: 1057 - protein, 114 aa, Artificial Sequence; identical to SEQ ID NO: 374
  Description of Artificial Sequence: Synthetic polypeptide
  XENP025850 human IL15

SEQ ID NO: 1058 - protein, 231 aa, Artificial Sequence; identical to SEQ ID NO: 64
  Description of Artificial Sequence: Synthetic polypeptide
  Fc chain of XENP025850

SEQ ID NO: 1059 - protein, 219 aa, Artificial Sequence; identical to SEQ ID NO: 216
  Description of Artificial Sequence: Synthetic polypeptide
  XENP025850 Chain 3 - 1C11[PD-1]_L3

SEQ ID NO: 1060 - protein, 112 aa, Artificial Sequence; identical to SEQ ID NO: 196
  Description of Artificial Sequence: Synthetic polypeptide
  VL of XENP025850

SEQ ID NO: 1061 - protein, 16 aa, Artificial Sequence
  Description of Artificial Sequence: Synthetic peptide
  XENP025850 vlCDR1
KSSQSIVHSNGNTYLE

SEQ ID NO: 1062 - protein, 7 aa, Artificial Sequence
  Description of Artificial Sequence: Synthetic peptide
  XENP025850 vlCDR2
KVSNRFS

SEQ ID NO: 1063 - protein, 9 aa, Artificial Sequence
  Description of Artificial Sequence: Synthetic peptide
  XENP025850 vlCDR3
FQGSHVPNT

SEQ ID NO: 1064 - protein, 446 aa, Artificial Sequence; identical to SEQ ID NO: 624
  Description of Artificial Sequence: Synthetic polypeptide
  XENP025937 Chain 1 - 1C11[PD-1]_H3_ IgG1_PVA _/S267K/S364K/E357Q/M428L/N434S

SEQ ID NO: 1065 - protein, 117 aa, Artificial Sequence; identical to SEQ ID NO: 192
  Description of Artificial Sequence: Synthetic polypeptide
  VH of XENP025937

SEQ ID NO: 1066 - protein, 5 aa, Artificial Sequence
  Description of Artificial Sequence: Synthetic peptide
  XENP025937 vhCDR1
HYGMN

SEQ ID NO: 1067 - protein, 17 aa, Artificial Sequence
  Description of Artificial Sequence: Synthetic peptide
  XENP025937 vhCDR2
WINTYTGEPTYADGFTG

SEQ ID NO: 1068 - protein, 8 aa, Artificial Sequence
  Description of Artificial Sequence: Synthetic peptide
  XENP025937 vhCDR3
DYYGSSPY

SEQ ID NO: 1069 - protein, 435 aa, Artificial Sequence; identical to SEQ ID NO: 629
  Description of Artificial Sequence: Synthetic polypeptide
  XENP025937 Chain 2 - human_IL15Ralpha(sushi)_(GGGGS)5-human _IL15(N4D/N65D;single-chain)_ Fc(216)_IgG1_pI (-)_Isosteric_A_C220S/PVA_/S267K/L368D/K370S/M428L/N434S

SEQ ID NO: 1070 - protein, 65 aa, Artificial Sequence; identical to SEQ ID NO: 4
  Description of Artificial Sequence: Synthetic polypeptide
  XENP025937 human IL15Ralpha(sushi)

SEQ ID NO: 1071 - protein, 114 aa, Artificial Sequence; identical to SEQ ID NO: 374
  Description of Artificial Sequence: Synthetic polypeptide
  XENP025937 human IL15

SEQ ID NO: 1072 - protein, 231 aa, Artificial Sequence; identical to SEQ ID NO: 84
  Description of Artificial Sequence: Synthetic polypeptide
  Fc chain of XENP025937

SEQ ID NO: 1073 - protein, 219 aa, Artificial Sequence; identical to SEQ ID NO: 216
  Description of Artificial Sequence: Synthetic polypeptide
  XENP025937 Chain 3 - 1C11[PD-1]_L3

SEQ ID NO: 1074 - protein, 112 aa, Artificial Sequence; identical to SEQ ID NO: 196
  Description of Artificial Sequence: Synthetic polypeptide
  VL of XENP025937

SEQ ID NO: 1075 - protein, 16 aa, Artificial Sequence
  Description of Artificial Sequence: Synthetic peptide
  XENP025937 vlCDR1
KSSQSIVHSNGNTYLE

SEQ ID NO: 1076 - protein, 7 aa, Artificial Sequence
  Description of Artificial Sequence: Synthetic peptide
  XENP025937 vlCDR2
KVSNRFS

SEQ ID NO: 1077 - protein, 9 aa, Artificial Sequence
  Description of Artificial Sequence: Synthetic peptide
  XENP025937 vlCDR3
FQGSHVPNT

SEQ ID NO: 1078 - protein, 114 aa, Artificial Sequence; identical to SEQ ID NO: 2
  Description of Artificial Sequence: Synthetic polypeptide
  XENP022112 Chain 1 - IL-15

SEQ ID NO: 1079 - protein, 451 aa, Artificial Sequence; identical to SEQ ID NO: 639
  Description of Artificial Sequence: Synthetic polypeptide
  XENP022112 Chain 2 - 1G6_H1.278[PD-1] _IgG1_pI(-)_Isosteric_A _C220S/PVA_/S267K/L368D/K370S

SEQ ID NO: 1080 - protein, 122 aa, Artificial Sequence; identical to SEQ ID NO: 559
  Description of Artificial Sequence: Synthetic polypeptide
  VH of XENP022112

SEQ ID NO: 1081 - protein, 5 aa, Artificial Sequence
  Description of Artificial Sequence: Synthetic peptide
  XENP022112 vhCDR1
NYWMN

SEQ ID NO: 1082 - protein, 19 aa, Artificial Sequence
  Description of Artificial Sequence: Synthetic peptide
  XENP022112 vhCDR2
EIRLYSNNYATHYAESVKG

SEQ ID NO: 1083 - protein, 11 aa, Artificial Sequence
  Description of Artificial Sequence: Synthetic peptide
  XENP022112 vhCDR3
YYGNYGGYFDV

SEQ ID NO: 1084 - protein, 296 aa, Artificial Sequence; identical to SEQ ID NO: 230
  Description of Artificial Sequence: Synthetic polypeptide
  XENP022112 Chain 3 - human_IL15Ralpha(Sushi)_Fc(216)_ IgG1 _C220S/PVA_/S267K/S364K/E357Q

SEQ ID NO: 1085 - protein, 65 aa, Artificial Sequence; identical to SEQ ID NO: 4
  Description of Artificial Sequence: Synthetic polypeptide
  XENP022112 human IL15Ralpha(Sushi)

SEQ ID NO: 1086 - protein, 231 aa, Artificial Sequence; identical to SEQ ID NO: 63
  Description of Artificial Sequence: Synthetic polypeptide
  Fc chain of human IL15Ralpha(Sushi)

SEQ ID NO: 1087 - protein, 214 aa, Artificial Sequence; identical to SEQ ID NO: 563
  Description of Artificial Sequence: Synthetic polypeptide
  XENP022112 Chain 4 - 1G6_L1.188[PD-1]

SEQ ID NO: 1088 - protein, 107 aa, Artificial Sequence; identical to SEQ ID NO: 564
  Description of Artificial Sequence: Synthetic polypeptide
  VL of XENP022112

SEQ ID NO: 1089 - protein, 11 aa, Artificial Sequence
  Description of Artificial Sequence: Synthetic peptide
  XENP022112 vlCDR1
RASQSVGNDVA

SEQ ID NO: 1090 - protein, 7 aa, Artificial Sequence
  Description of Artificial Sequence: Synthetic peptide
  XENP022112 vlCDR2
YASHRYT

SEQ ID NO: 1091 - protein, 9 aa, Artificial Sequence
  Description of Artificial Sequence: Synthetic peptide
  XENP022112 vlCDR3
QQDFSSPRT

SEQ ID NO: 1092 - protein, 114 aa, Artificial Sequence; identical to SEQ ID NO: 274
  Description of Artificial Sequence: Synthetic polypeptide
  XENP022641 Chain 1 - IL-15(E87C)

SEQ ID NO: 1093 - protein, 451 aa, Artificial Sequence; identical to SEQ ID NO: 639
  Description of Artificial Sequence: Synthetic polypeptide
  XENP022641 Chain 2 - 1G6_H1.278_ IgG1_pI(-)_Isosteric_A _C220S/PVA_/S267K/L368D/K370S

SEQ ID NO: 1094 - protein, 122 aa, Artificial Sequence; identical to SEQ ID NO: 559
  Description of Artificial Sequence: Synthetic polypeptide
  VH of XENP022641

SEQ ID NO: 1095 - protein, 5 aa, Artificial Sequence
  Description of Artificial Sequence: Synthetic peptide
  XENP022641 vhCDR1
NYWMN

SEQ ID NO: 1096 - protein, 19 aa, Artificial Sequence
  Description of Artificial Sequence: Synthetic peptide
  XENP022641 vhCDR2
EIRLYSNNYATHYAESVKG

SEQ ID NO: 1097 - protein, 11 aa, Artificial Sequence
  Description of Artificial Sequence: Synthetic peptide
  XENP022641 vhCDR3
YYGNYGGYFDV

SEQ ID NO: 1098 - protein, 298 aa, Artificial Sequence; identical to SEQ ID NO: 504
  Description of Artificial Sequence: Synthetic polypeptide
  XENP022641 Chain 3 - human_IL15Ralpha(Sushi-D96/C97)_Fc(216) _ IgG1_C220S/PVA_/S267K/S364K/E357Q

SEQ ID NO: 1099 - protein, 67 aa, Artificial Sequence; identical to SEQ ID NO: 282
  Description of Artificial Sequence: Synthetic polypeptide
  XENP022641 human IL15Ralpha(Sushi)

SEQ ID NO: 1100 - protein, 231 aa, Artificial Sequence; identical to SEQ ID NO: 63
  Description of Artificial Sequence: Synthetic polypeptide
  Fc chain of human IL15Ralpha(Sushi)

SEQ ID NO: 1101 - protein, 214 aa, Artificial Sequence; identical to SEQ ID NO: 563
  Description of Artificial Sequence: Synthetic polypeptide
  XENP022641 Chain 4 - 1G6_L1.188[PD-1]

SEQ ID NO: 1102 - protein, 107 aa, Artificial Sequence; identical to SEQ ID NO: 564
  Description of Artificial Sequence: Synthetic polypeptide
  VL of XENP022641

SEQ ID NO: 1103 - protein, 11 aa, Artificial Sequence
  Description of Artificial Sequence: Synthetic peptide
  XENP022641 vlCDR1
RASQSVGNDVA

SEQ ID NO: 1104 - protein, 7 aa, Artificial Sequence
  Description of Artificial Sequence: Synthetic peptide
  XENP022641 vlCDR2
YASHRYT

SEQ ID NO: 1105 - protein, 9 aa, Artificial Sequence
  Description of Artificial Sequence: Synthetic peptide
  XENP022641 vlCDR3
QQDFSSPRT

SEQ ID NO: 1106 - protein, 659 aa, Artificial Sequence; identical to SEQ ID NO: 666
  Description of Artificial Sequence: Synthetic polypeptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D)

SEQ ID NO: 1107 - protein, 117 aa, Artificial Sequence; identical to SEQ ID NO: 192
  Description of Artificial Sequence: Synthetic polypeptide
  VH of Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D)

SEQ ID NO: 1108 - protein, 65 aa, Artificial Sequence; identical to SEQ ID NO: 4
  Description of Artificial Sequence: Synthetic polypeptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) IL15Ralpha(sushi)

SEQ ID NO: 1109 - protein, 114 aa, Artificial Sequence; identical to SEQ ID NO: 374
  Description of Artificial Sequence: Synthetic polypeptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) IL15

SEQ ID NO: 1110 - protein, 5 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) vhCDR1
HYGMN

SEQ ID NO: 1111 - protein, 17 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) vhCDR2
WINTYTGEPTYADGFTG

SEQ ID NO: 1112 - protein, 8 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S_(GGGGS)2_IL15Ralpha(sushi) _(GGGGS)5-IL15(N4D/N65D) vhCDR3
DYYGSSPY

SEQ ID NO: 1113 - protein, 446 aa, Artificial Sequence; identical to SEQ ID NO: 568
  Description of Artificial Sequence: Synthetic polypeptide
  Chain 2 - 1C11[PD-1]_H3_ IgG1_ PVA_/S267K/S364K/E357Q

SEQ ID NO: 1114 - protein, 117 aa, Artificial Sequence; identical to SEQ ID NO: 192
  Description of Artificial Sequence: Synthetic polypeptide
  VH of Chain 2 - 1C11[PD-1]_H3_ IgG1_ PVA_/S267K/S364K/E357Q

SEQ ID NO: 1115 - protein, 5 aa, Artificial Sequence
  Description of Artificial Sequence: Synthetic peptide
  Chain 2 - 1C11[PD-1]_H3_ IgG1_ PVA_/S267K/S364K/E357Q vhCDR1
HYGMN

SEQ ID NO: 1116 - protein, 17 aa, Artificial Sequence
  Description of Artificial Sequence: Synthetic peptide
  Chain 2 - 1C11[PD-1]_H3_ IgG1_ PVA_/S267K/S364K/E357Q vhCDR2
WINTYTGEPTYADGFTG

SEQ ID NO: 1117 - protein, 8 aa, Artificial Sequence
  Description of Artificial Sequence: Synthetic peptide
  Chain 2 - 1C11[PD-1]_H3_ IgG1_ PVA_/S267K/S364K/E357Q vhCDR3
DYYGSSPY

SEQ ID NO: 1118 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 1119 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 1120 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 1121 - protein, 7 aa, Artificial Sequence
  Description of Artificial Sequence: Synthetic peptide
  Chain 3 - 1C11[PD-1]_L3 vlCDR2
KVSNRFS

SEQ ID NO: 1122 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 1123 - protein, 660 aa, Artificial Sequence; identical to SEQ ID NO: 683
  Description of Artificial Sequence: Synthetic polypeptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain)

SEQ ID NO: 1124 - protein, 117 aa, Artificial Sequence; identical to SEQ ID NO: 192
  Description of Artificial Sequence: Synthetic polypeptide
  VH of Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain)

SEQ ID NO: 1125 - protein, 65 aa, Artificial Sequence; identical to SEQ ID NO: 4
  Description of Artificial Sequence: Synthetic polypeptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) IL15Ralpha(Sushi)

SEQ ID NO: 1126 - protein, 114 aa, Artificial Sequence; identical to SEQ ID NO: 2
  Description of Artificial Sequence: Synthetic polypeptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) IL15

SEQ ID NO: 1127 - protein, 5 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) vhCDR1
HYGMN

SEQ ID NO: 1128 - protein, 17 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) vhCDR2
WINTYTGEPTYADGFTG

SEQ ID NO: 1129 - protein, 8 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S__(GGGGS)5_IL15Ralpha(Sushi) _IL15(single-chain) vhCDR3
DYYGSSPY

SEQ ID NO: 1130 - protein, 446 aa, Artificial Sequence; identical to SEQ ID NO: 690
  Description of Artificial Sequence: Synthetic polypeptide
  Chain 2 - 1C11[PD-1]_H3_IgG1_pI_ISO(+RR)_/PVA _/S267K/S364K/E357Q

SEQ ID NO: 1131 - protein, 117 aa, Artificial Sequence; identical to SEQ ID NO: 192
  Description of Artificial Sequence: Synthetic polypeptide
  VH of Chain 2 - 1C11[PD-1]_H3_IgG1_pI_ISO(+RR)_/PVA _/S267K/S364K/E357Q

SEQ ID NO: 1132 - protein, 5 aa, Artificial Sequence
  Description of Artificial Sequence: Synthetic peptide
  Chain 2 - 1C11[PD-1]_H3_IgG1_pI_ISO(+RR)_/PVA _/S267K/S364K/E357Q vhCDR1
HYGMN

SEQ ID NO: 1133 - protein, 17 aa, Artificial Sequence
  Description of Artificial Sequence: Synthetic peptide
  Chain 2 - 1C11[PD-1]_H3_IgG1_pI_ISO(+RR)_/PVA _/S267K/S364K/E357Q vhCDR2
WINTYTGEPTYADGFTG

SEQ ID NO: 1134 - protein, 8 aa, Artificial Sequence
  Description of Artificial Sequence: Synthetic peptide
  Chain 2 - 1C11[PD-1]_H3_IgG1_pI_ISO(+RR)_/PVA _/S267K/S364K/E357Q vhCDR3
DYYGSSPY

SEQ ID NO: 1135 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 1136 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 1137 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 1138 - protein, 7 aa, Artificial Sequence
  Description of Artificial Sequence: Synthetic peptide
  Chain 3 - 1C11[PD-1]_L3 vlCDR2
KVSNRFS

SEQ ID NO: 1139 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 1140 - protein, 446 aa, Artificial Sequence; identical to SEQ ID NO: 700
  Description of Artificial Sequence: Synthetic polypeptide
  Chain 1 - 1C11[PD-1]_H3_ IgG1_pI(-)_Isosteric_A_PVA _/S267K/L368D/K370S

SEQ ID NO: 1141 - protein, 117 aa, Artificial Sequence; identical to SEQ ID NO: 192
  Description of Artificial Sequence: Synthetic polypeptide
  VH of Chain 1 - 1C11[PD-1]_H3_ IgG1_pI(-)_Isosteric_A_PVA _/S267K/L368D/K370S

SEQ ID NO: 1142 - protein, 5 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S vhCDR1
HYGMN

SEQ ID NO: 1143 - protein, 17 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S vhCDR2
WINTYTGEPTYADGFTG

SEQ ID NO: 1144 - protein, 8 aa, Artificial Sequence
  Description of Artificial Sequence: Synthetic peptide
  Chain 1 - 1C11[PD-1]_H3_ IgG1_pI(-)_Isosteric_A_PVA _/S267K/L368D/K370S vhCDR3
DYYGSSPY

SEQ ID NO: 1145 - protein, 660 aa, Artificial Sequence; identical to SEQ ID NO: 705
  Description of Artificial Sequence: Synthetic polypeptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain)

SEQ ID NO: 1146 - protein, 117 aa, Artificial Sequence; identical to SEQ ID NO: 192
  Description of Artificial Sequence: Synthetic polypeptide
  VH of Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain)

SEQ ID NO: 1147 - protein, 65 aa, Artificial Sequence; identical to SEQ ID NO: 4
  Description of Artificial Sequence: Synthetic polypeptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) IL15Ralpha(Sushi)

SEQ ID NO: 1148 - protein, 114 aa, Artificial Sequence; identical to SEQ ID NO: 2
  Description of Artificial Sequence: Synthetic polypeptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) IL15

SEQ ID NO: 1149 - protein, 5 aa, Artificial Sequence
  Description of Artificial Sequence: Synthetic peptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) vhCDR1
HYGMN

SEQ ID NO: 1150 - protein, 17 aa, Artificial Sequence
  Description of Artificial Sequence: Synthetic peptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) vhCDR2
WINTYTGEPTYADGFTG

SEQ ID NO: 1151 - protein, 8 aa, Artificial Sequence
  Description of Artificial Sequence: Synthetic peptide
  Chain 2 - 1C11[PD-1]_H3_ IgG1_pI_ISO(+RR)_/PVA _/S267K/S364K/E357Q_(GGGGS)5_IL15Ralpha(Sushi) _IL15(single-chain) vhCDR3
DYYGSSPY

SEQ ID NO: 1152 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 1153 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 1154 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 1155 - protein, 7 aa, Artificial Sequence
  Description of Artificial Sequence: Synthetic peptide
  Chain 3 - 1C11[PD-1]_L3 vlCDR2
KVSNRFS

SEQ ID NO: 1156 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 1157 - protein, 114 aa, Artificial Sequence; identical to SEQ ID NO: 2
  Description of Artificial Sequence: Synthetic polypeptide
  XENP022642 Chain 1 - IL-15

SEQ ID NO: 1158 - protein, 517 aa, Artificial Sequence; identical to SEQ ID NO: 718
  Description of Artificial Sequence: Synthetic polypeptide
  XENP022642 Chain 2 - Nivolumab_H0_ IgG1_pI(-)_Isosteric_A_PVA _/S267K/L368D/K370S__(GGGGS)2_IL15Ralpha(Sushi)

SEQ ID NO: 1159 - protein, 113 aa, Artificial Sequence [sequence omitted]

SEQ ID NO: 1160 - protein, 65 aa, Artificial Sequence; identical to SEQ ID NO: 4
  Description of Artificial Sequence: Synthetic polypeptide
  XENP022642 IL15Ralpha(Sushi)

SEQ ID NO: 1161 - protein, 5 aa, Artificial Sequence
  Description of Artificial Sequence: Synthetic peptide
  XENP022642 vhCDR1
NSGMH

SEQ ID NO: 1162 - protein, 17 aa, Artificial Sequence
  Description of Artificial Sequence: Synthetic peptide
  XENP022642 vhCDR2
VIWYDGSKRYYADSVKG

SEQ ID NO: 1163 - protein, 4 aa, Artificial Sequence
  Description of Artificial Sequence: Synthetic peptide
  XENP022642 vhCDR3
NDDY

SEQ ID NO: 1164 - protein, 442 aa, Artificial Sequence; identical to SEQ ID NO: 724
  Description of Artificial Sequence: Synthetic polypeptide
  XENP022642 Chain 3 - Nivolumab_H0_IgG1_pI_ISO(+RR)_/PVA _/S267K/S364K/E357Q

SEQ ID NO: 1165 - protein, 113 aa, Artificial Sequence [sequence omitted]

SEQ ID NO: 1166 - protein, 5 aa, Artificial Sequence
  Description of Artificial Sequence: Synthetic peptide
  XENP022642 vhCDR1
NSGMH

SEQ ID NO: 1167 - protein, 17 aa, Artificial Sequence
  Description of Artificial Sequence: Synthetic peptide
  XENP022642 vhCDR2
VIWYDGSKRYYADSVKG

SEQ ID NO: 1168 - protein, 4 aa, Artificial Sequence
  Description of Artificial Sequence: Synthetic peptide
  XENP022642 vhCDR3
NDDY

SEQ ID NO: 1169 - protein, 214 aa, Artificial Sequence; identical to SEQ ID NO: 106
  Description of Artificial Sequence: Synthetic polypeptide
  XENP022642 Chain 4 - Nivolumab_L0

SEQ ID NO: 1170 - protein, 107 aa, Artificial Sequence [sequence omitted]

SEQ ID NO: 1171 - protein, 11 aa, Artificial Sequence
  Description of Artificial Sequence: Synthetic peptide
  XENP022642 vlCDR1
RASQSVSSYLA

SEQ ID NO: 1172 - protein, 7 aa, Artificial Sequence
  Description of Artificial Sequence: Synthetic peptide
  XENP022642 vlCDR2
DASNRAT

SEQ ID NO: 1173 - protein, 9 aa, Artificial Sequence
  Description of Artificial Sequence: Synthetic peptide
  XENP022642 vlCDR3
QQSSNWPRT

SEQ ID NO: 1174 - protein, 114 aa, Artificial Sequence; identical to SEQ ID NO: 2
  Description of Artificial Sequence: Synthetic polypeptide
  XENP022643 Chain 1 - IL-15

SEQ ID NO: 1175 - protein, 442 aa, Artificial Sequence; identical to SEQ ID NO: 735
  Description of Artificial Sequence: Synthetic polypeptide
  XENP022643 Chain 2 - Nivolumab_H0_ IgG1_pI(-)_Isosteric_A_PVA _/S267K/L368D/K370S

SEQ ID NO: 1176 - protein, 113 aa, Artificial Sequence [sequence omitted]

SEQ ID NO: 1177 - protein, 5 aa, Artificial Sequence
  Description of Artificial Sequence: Synthetic peptide
  XENP022643 vhCDR1
NSGMH

SEQ ID NO: 1178 - protein, 17 aa, Artificial Sequence
  Description of Artificial Sequence: Synthetic peptide
  XENP022643 vhCDR2
VIWYDGSKRYYADSVKG

SEQ ID NO: 1179 - protein, 4 aa, Artificial Sequence
  Description of Artificial Sequence: Synthetic peptide
  XENP022643 vhCDR3
NDDY

SEQ ID NO: 1180 - protein, 517 aa, Artificial Sequence; identical to SEQ ID NO: 740
  Description of Artificial Sequence: Synthetic polypeptide
  XENP022643 Chain 3 - Nivolumab_H0_ IgG1_pI_ISO(+RR)_/PVA _/S267K/S364K/E357Q_(GGGGS)2_IL15Ralpha(Sushi)

SEQ ID NO: 1181 - protein, 113 aa, Artificial Sequence [sequence omitted]

SEQ ID NO: 1182 - protein, 65 aa, Artificial Sequence; identical to SEQ ID NO: 4
  Description of Artificial Sequence: Synthetic polypeptide
  XENP022643 IL15Ralpha(Sushi)

SEQ ID NO: 1183 - protein, 5 aa, Artificial Sequence
  Description of Artificial Sequence: Synthetic peptide
  XENP022643 vhCDR1
NSGMH

SEQ ID NO: 1184 - protein, 17 aa, Artificial Sequence
  Description of Artificial Sequence: Synthetic peptide
  XENP022643 vhCDR2
VIWYDGSKRYYADSVKG

SEQ ID NO: 1185 - protein, 4 aa, Artificial Sequence
  Description of Artificial Sequence: Synthetic peptide
  XENP022643 vhCDR3
NDDY

SEQ ID NO: 1186 - protein, 214 aa, Artificial Sequence; identical to SEQ ID NO: 106
  Description of Artificial Sequence: Synthetic polypeptide
  XENP022643 Chain 4 - Nivolumab_L0

SEQ ID NO: 1187 - protein, 107 aa, Artificial Sequence [sequence omitted]

SEQ ID NO: 1188 - protein, 11 aa, Artificial Sequence
  Description of Artificial Sequence: Synthetic peptide
  XENP022643 vlCDR1
RASQSVSSYLA

SEQ ID NO: 1189 - protein, 7 aa, Artificial Sequence
  Description of Artificial Sequence: Synthetic peptide
  XENP022643 vlCDR2
DASNRAT

SEQ ID NO: 1190 - protein, 9 aa, Artificial Sequence
  Description of Artificial Sequence: Synthetic peptide
  XENP022643 vlCDR3
QQSSNWPRT

SEQ ID NO: 1191 - protein, 114 aa, Artificial Sequence; identical to SEQ ID NO: 274
  Description of Artificial Sequence: Synthetic polypeptide
  XENP022644 Chain 1 - IL-15(E87C)

SEQ ID NO: 1192 - protein, 519 aa, Artificial Sequence; identical to SEQ ID NO: 752
  Description of Artificial Sequence: Synthetic polypeptide
  XENP022644 Chain 2 - Nivolumab_H0_IgG1_pI(-)_Isosteric_A_PVA _/S267K/L368D/K370S_(GGGGS)2_IL15Ralpha(Sushi-D96/C97)

SEQ ID NO: 1193 - protein, 113 aa, Artificial Sequence [sequence omitted]

SEQ ID NO: 1194 - protein, 67 aa, Artificial Sequence; identical to SEQ ID NO: 282
  Description of Artificial Sequence: Synthetic polypeptide
  XENP022644 IL15Ralpha(Sushi)

SEQ ID NO: 1195 - protein, 5 aa, Artificial Sequence
  Description of Artificial Sequence: Synthetic peptide
  XENP022644 vhCDR1
NSGMH

SEQ ID NO: 1196 - protein, 17 aa, Artificial Sequence
  Description of Artificial Sequence: Synthetic peptide
  XENP022644 vhCDR2
VIWYDGSKRYYADSVKG

SEQ ID NO: 1197 - protein, 4 aa, Artificial Sequence
  Description of Artificial Sequence: Synthetic peptide
  XENP022644 vhCDR3
NDDY

SEQ ID NO: 1198 - protein, 442 aa, Artificial Sequence; identical to SEQ ID NO: 724
  Description of Artificial Sequence: Synthetic polypeptide
  XENP022644 Chain 3 - Nivolumab_H0_ IgG1_pI_ISO(+RR)_/PVA _/S267K/S364K/E357Q

SEQ ID NO: 1199 - protein, 113 aa, Artificial Sequence [sequence omitted]

SEQ ID NO: 1200 - protein, 5 aa, Artificial Sequence
  Description of Artificial Sequence: Synthetic peptide
  XENP022644 vhCDR1
NSGMH

SEQ ID NO: 1201 - protein, 17 aa, Artificial Sequence
  Description of Artificial Sequence: Synthetic peptide
  XENP022644 vhCDR2
VIWYDGSKRYYADSVKG

SEQ ID NO: 1202 - protein, 4 aa, Artificial Sequence
  Description of Artificial Sequence: Synthetic peptide
  XENP022644 vhCDR3
NDDY

SEQ ID NO: 1203 - protein, 214 aa, Artificial Sequence; identical to SEQ ID NO: 106
  Description of Artificial Sequence: Synthetic polypeptide
  XENP022644 Chain 4 - Nivolumab_L0

SEQ ID NO: 1204 - protein, 107 aa, Artificial Sequence [sequence omitted]

SEQ ID NO: 1205 - protein, 11 aa, Artificial Sequence
  Description of Artificial Sequence: Synthetic peptide
  XENP022644 vlCDR1
RASQSVSSYLA

SEQ ID NO: 1206 - protein, 7 aa, Artificial Sequence
  Description of Artificial Sequence: Synthetic peptide
  XENP022644 vlCDR2
DASNRAT

SEQ ID NO: 1207 - protein, 9 aa, Artificial Sequence
  Description of Artificial Sequence: Synthetic peptide
  XENP022644 vlCDR3
QQSSNWPRT

SEQ ID NO: 1208 - protein, 114 aa, Artificial Sequence; identical to SEQ ID NO: 274
  Description of Artificial Sequence: Synthetic polypeptide
  XENP022645 Chain 1 - IL-15(E87C)

SEQ ID NO: 1209 - protein, 442 aa, Artificial Sequence; identical to SEQ ID NO: 735
  Description of Artificial Sequence: Synthetic polypeptide
  XENP022645 Chain 2 - Nivolumab_H0_ IgG1_pI(-)_Isosteric_A_PVA _/S267K/L368D/K370S

SEQ ID NO: 1210 - protein, 113 aa, Artificial Sequence [sequence omitted]

SEQ ID NO: 1211 - protein, 5 aa, Artificial Sequence
  Description of Artificial Sequence: Synthetic peptide
  XENP022645 vhCDR1
NSGMH

SEQ ID NO: 1212 - protein, 17 aa, Artificial Sequence
  Description of Artificial Sequence: Synthetic peptide
  XENP022645 vhCDR2
VIWYDGSKRYYADSVKG

SEQ ID NO: 1213 - protein, 4 aa, Artificial Sequence
  Description of Artificial Sequence: Synthetic peptide
  XENP022645 vhCDR3
NDDY

SEQ ID NO: 1214 - protein, 519 aa, Artificial Sequence; identical to SEQ ID NO: 774
  Description of Artificial Sequence: Synthetic polypeptide
  XENP022645 Chain 3 - Nivolumab_H0_ IgG1_pI_ISO(+RR)_/PVA _/S267K/S364K/E357Q_(GGGGS)2_IL15Ralpha(Sushi-D96/C97)

SEQ ID NO: 1215 - protein, 113 aa, Artificial Sequence [sequence omitted]

SEQ ID NO: 1216 - protein, 67 aa, Artificial Sequence; identical to SEQ ID NO: 282
  Description of Artificial Sequence: Synthetic polypeptide
  XENP022645 IL15Ralpha(Sushi)

SEQ ID NO: 1217 - protein, 5 aa, Artificial Sequence
  Description of Artificial Sequence: Synthetic peptide
  XENP022645 vhCDR1
NSGMH

SEQ ID NO: 1218 - protein, 17 aa, Artificial Sequence
  Description of Artificial Sequence: Synthetic peptide
  XENP022645 vhCDR2
VIWYDGSKRYYADSVKG

SEQ ID NO: 1219 - protein, 4 aa, Artificial Sequence
  Description of Artificial Sequence: Synthetic peptide
  XENP022645 vhCDR3
NDDY

SEQ ID NO: 1220 - protein, 214 aa, Artificial Sequence; identical to SEQ ID NO: 106
  Description of Artificial Sequence: Synthetic polypeptide
  XENP022645 Chain 4 - Nivolumab_L0

SEQ ID NO: 1221 - protein, 107 aa, Artificial Sequence [sequence omitted]

SEQ ID NO: 1222 - protein, 11 aa, Artificial Sequence
  Description of Artificial Sequence: Synthetic peptide
  XENP022645 vlCDR1
RASQSVSSYLA

SEQ ID NO: 1223 - protein, 7 aa, Artificial Sequence
  Description of Artificial Sequence: Synthetic peptide
  XENP022645 vlCDR2
DASNRAT

SEQ ID NO: 1224 - protein, 9 aa, Artificial Sequence
  Description of Artificial Sequence: Synthetic peptide
  XENP022645 vlCDR3
QQSSNWPRT

SEQ ID NO: 1225 - protein, 580 aa, Artificial Sequence; identical to SEQ ID NO: 785
  Description of Artificial Sequence: Synthetic polypeptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S

SEQ ID NO: 1226 - protein, 117 aa, Artificial Sequence; identical to SEQ ID NO: 192
  Description of Artificial Sequence: Synthetic polypeptide
  VH of Chain 1 - 1C11[PD-1]_H3_IL15_N4D/N65D_(GGGGS)1_Fc(216) _IgG1_pI(-)_Isosteric_A_C220S/PVA_/S267K/L368D/K370S

SEQ ID NO: 1227 - protein, 114 aa, Artificial Sequence; identical to SEQ ID NO: 374
  Description of Artificial Sequence: Synthetic polypeptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S IL15

SEQ ID NO: 1228 - protein, 231 aa, Artificial Sequence; identical to SEQ ID NO: 64
  Description of Artificial Sequence: Synthetic polypeptide
  Fc chain of Chain 1 - 1C11[PD-1]_H3_IL15_N4D/N65D_(GGGGS)1 _Fc(216)_IgG1_pI(-)_Isosteric_A_C220S/PVA _/S267K/L368D/K370S

SEQ ID NO: 1229 - protein, 5 aa, Artificial Sequence
  Description of Artificial Sequence: Synthetic peptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S vhCDR1
HYGMN

SEQ ID NO: 1230 - protein, 17 aa, Artificial Sequence
  Description of Artificial Sequence: Synthetic peptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S vhCDR2
WINTYTGEPTYADGFTG

SEQ ID NO: 1231 - protein, 8 aa, Artificial Sequence
  Description of Artificial Sequence: Synthetic peptide
  Chain 1 - 1C11[PD-1]_H3_IL15_N4D/N65D_(GGGGS)1_Fc(216)_IgG1 _pI(-)_Isosteric_A_C220S/PVA_/S267K/L368D/K370S vhCDR3
DYYGSSPY

SEQ ID NO: 1232 - protein, 531 aa, Artificial Sequence; identical to SEQ ID NO: 792
  Description of Artificial Sequence: Synthetic polypeptide
  Chain 2 - 1C11[PD-1]_H3_IL15Ralpha(sushi)_(GGGGS)1_Fc(216) _IgG1_C220S/PVA_/S267K/S364K/E357Q

SEQ ID NO: 1233 - protein, 117 aa, Artificial Sequence; identical to SEQ ID NO: 192
  Description of Artificial Sequence: Synthetic polypeptide
  VH of Chain 2 - 1C11[PD-1]_H3_IL15Ralpha(sushi)_(GGGGS)1 _Fc(216)_IgG1_C220S/PVA_/S267K/S364K/E357Q

SEQ ID NO: 1234 - protein, 65 aa, Artificial Sequence; identical to SEQ ID NO: 4
  Description of Artificial Sequence: Synthetic polypeptide
  Chain 2 - 1C11[PD-1]_H3_IL15Ralpha(sushi)_(GGGGS)1_Fc(216) _IgG1_C220S/PVA_/S267K/S364K/E357Q IL15Ralpha(sushi)

SEQ ID NO: 1235 - protein, 231 aa, Artificial Sequence; identical to SEQ ID NO: 63
  Description of Artificial Sequence: Synthetic polypeptide
  Fc chain of Chain 2 - 1C11[PD-1]_H3_IL15Ralpha(sushi)_(GGGGS)1 _Fc(216)_IgG1_C220S/PVA_/S267K/S364K/E357Q

SEQ ID NO: 1236 - protein, 5 aa, Artificial Sequence
  Description of Artificial Sequence: Synthetic peptide
  Chain 2 - 1C11[PD-1]_H3_IL15Ralpha(sushi)_(GGGGS)1_Fc(216) _IgG1_C220S/PVA_/S267K/S364K/E357Q vhCDR1
HYGMN

SEQ ID NO: 1237 - protein, 17 aa, Artificial Sequence
  Description of Artificial Sequence: Synthetic peptide
  Chain 2 - 1C11[PD-1]_H3_IL15Ralpha(sushi)_(GGGGS)1_Fc(216) _IgG1_C220S/PVA_/S267K/S364K/E357Q vhCDR2
WINTYTGEPTYADGFTG

SEQ ID NO: 1238 - protein, 8 aa, Artificial Sequence
  Description of Artificial Sequence: Synthetic peptide
  Chain 2 - 1C11[PD-1]_H3_IL15Ralpha(sushi)_(GGGGS)1_Fc(216) _IgG1_C220S/PVA_/S267K/S364K/E357Q vhCDR3
DYYGSSPY

SEQ ID NO: 1239 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 1240 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 1241 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 1242 - protein, 7 aa, Artificial Sequence
  Description of Artificial Sequence: Synthetic peptide
  Chain 3 - 1C11[PD-1]_L3 vlCDR2
KVSNRFS

SEQ ID NO: 1243 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 1244 - protein, 665 aa, Artificial Sequence; identical to SEQ ID NO: 804
  Description of Artificial Sequence: Synthetic polypeptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S

SEQ ID NO: 1245 - protein, 117 aa, Artificial Sequence; identical to SEQ ID NO: 192
  Description of Artificial Sequence: Synthetic polypeptide
  VH of Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S

SEQ ID NO: 1246 - protein, 65 aa, Artificial Sequence; identical to SEQ ID NO: 4
  Description of Artificial Sequence: Synthetic polypeptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S IL15Ralpha(sushi)

SEQ ID NO: 1247 - protein, 114 aa, Artificial Sequence; identical to SEQ ID NO: 374
  Description of Artificial Sequence: Synthetic polypeptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S IL15

SEQ ID NO: 1248 - protein, 231 aa, Artificial Sequence; identical to SEQ ID NO: 64
  Description of Artificial Sequence: Synthetic polypeptide
  Fc chain of Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S

SEQ ID NO: 1249 - protein, 5 aa, Artificial Sequence
  Description of Artificial Sequence: Synthetic peptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S vhCDR1
HYGMN

SEQ ID NO: 1250 - protein, 17 aa, Artificial Sequence
  Description of Artificial Sequence: Synthetic peptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S vhCDR2
WINTYTGEPTYADGFTG

SEQ ID NO: 1251 - protein, 8 aa, Artificial Sequence
  Description of Artificial Sequence: Synthetic peptide
  Chain 1 - 1C11[PD-1]_H3_IL15Ralpha(sushi) _(GGGGS)5-IL15(N4D/N65D)_IgG1_pI(-) _Isosteric_A_C220S/PVA_/S267K/L368D/K370S vhCDR3
DYYGSSPY

SEQ ID NO: 1252 - protein, 446 aa, Artificial Sequence; identical to SEQ ID NO: 568
  Description of Artificial Sequence: Synthetic polypeptide
  Chain 2 - 1C11[PD-1]_H3_IgG1_C220S/PVA_/S267K/S364K/E357Q

SEQ ID NO: 1253 - protein, 117 aa, Artificial Sequence; identical to SEQ ID NO: 192
  Description of Artificial Sequence: Synthetic polypeptide
  VH of Chain 2 - 1C11[PD-1]_H3_IgG1_C220S/PVA _/S267K/S364K/E357Q

SEQ ID NO: 1254 - protein, 5 aa, Artificial Sequence
  Description of Artificial Sequence: Synthetic peptide
  Chain 2 - 1C11[PD-1]_H3_IgG1_C220S/PVA _/S267K/S364K/E357Q vhCDR1
HYGMN

SEQ ID NO: 1255 - protein, 17 aa, Artificial Sequence
  Description of Artificial Sequence: Synthetic peptide
  Chain 2 - 1C11[PD-1]_H3_IgG1_C220S/PVA _/S267K/S364K/E357Q vhCDR2
WINTYTGEPTYADGFTG

SEQ ID NO: 1256 - protein, 8 aa, Artificial Sequence
  Description of Artificial Sequence: Synthetic peptide
  Chain 2 - 1C11[PD-1]_H3_IgG1_C220S/PVA _/S267K/S364K/E357Q vhCDR3
DYYGSSPY

SEQ ID NO: 1257 - protein, 219 aa, Artificial Sequence; identical to SEQ ID NO: 216
  Description of Artificial Sequence: Synthetic polypeptide
  Chain 3 - 1C11[PD-1]_L3

SEQ ID NO: 1258 - protein, 112 aa, Artificial Sequence; identical to SEQ ID NO: 196
  Description of Artificial Sequence: Synthetic polypeptide
  VL of Chain 3 - 1C11[PD-1]_L3

SEQ ID NO: 1259 - protein, 16 aa, Artificial Sequence
  Description of Artificial Sequence: Synthetic peptide
  Chain 3 - 1C11[PD-1]_L3 vlCDR1
KSSQSIVHSNGNTYLE

SEQ ID NO: 1260 - protein, 7 aa, Artificial Sequence
  Description of Artificial Sequence: Synthetic peptide
  Chain 3 - 1C11[PD-1]_L3 vlCDR2
KVSNRFS

SEQ ID NO: 1261 - protein, 9 aa, Artificial Sequence
  Description of Artificial Sequence: Synthetic peptide
  Chain 3 - 1C11[PD-1]_L3 vlCDR3
FQGSHVPNT

SEQ ID NO: 1262 - protein, 120 aa, Artificial Sequence [sequence omitted]

SEQ ID NO: 1263 - protein, 5 aa, Artificial Sequence
  Description of Artificial Sequence: Synthetic peptide
  pembrolizumab[PD-1] variable heavy Chain vhCDR1
NYYMY

SEQ ID NO: 1264 - protein, 17 aa, Artificial Sequence
  Description of Artificial Sequence: Synthetic peptide
  pembrolizumab[PD-1] variable heavy Chain vhCDR2
GINPSNGGTNFNEKFKN

SEQ ID NO: 1265 - protein, 11 aa, Artificial Sequence
  Description of Artificial Sequence: Synthetic peptide
  pembrolizumab[PD-1] variable heavy Chain vhCDR3
RDYRFDMGFDY

SEQ ID NO: 1266 - protein, 111 aa, Artificial Sequence [sequence omitted]

SEQ ID NO: 1267 - protein, 15 aa, Artificial Sequence
  Description of Artificial Sequence: Synthetic peptide
  pembrolizumab[PD-1] variable light Chain vlCDR1
RASKGVSTSGYSYLH

SEQ ID NO: 1268 - protein, 7 aa, Artificial Sequence
  Description of Artificial Sequence: Synthetic peptide
  pembrolizumab[PD-1] variable light Chain vlCDR2
LASYLES

SEQ ID NO: 1269 - protein, 9 aa, Artificial Sequence
  Description of Artificial Sequence: Synthetic peptide
  pembrolizumab[PD-1] variable light Chain vlCDR3
QHSRDLPLT

SEQ ID NO: 1270 - protein, 113 aa, Artificial Sequence [sequence omitted]

SEQ ID NO: 1271 - protein, 5 aa, Artificial Sequence
  Description of Artificial Sequence: Synthetic peptide
  nivolumab[PD-1] variable heavy Chain vhCDR1
NSGMH

SEQ ID NO: 1272 - protein, 17 aa, Artificial Sequence
  Description of Artificial Sequence: Synthetic peptide
  nivolumab[PD-1] variable heavy Chain vhCDR2
VIWYDGSKRYYADSVKG

SEQ ID NO: 1273 - protein, 4 aa, Artificial Sequence
  Description of Artificial Sequence: Synthetic peptide
  nivolumab[PD-1] variable heavy Chain vhCDR3
NDDY

SEQ ID NO: 1274 - protein, 107 aa, Artificial Sequence [sequence omitted]

SEQ ID NO: 1275 - protein, 11 aa, Artificial Sequence
  Description of Artificial Sequence: Synthetic peptide
  nivolumab[PD-1] variable light Chain vlCDR1
RASQSVSSYLA

SEQ ID NO: 1276 - protein, 7 aa, Artificial Sequence
  Description of Artificial Sequence: Synthetic peptide
  nivolumab[PD-1] variable light Chain vlCDR2
DASNRAT

SEQ ID NO: 1277 - protein, 9 aa, Artificial Sequence
  Description of Artificial Sequence: Synthetic peptide
  nivolumab[PD-1] variable light Chain vlCDR3
QQSSNWPRT

SEQ ID NO: 1278 - protein, 117 aa, Artificial Sequence
  Description of Artificial Sequence: Synthetic polypeptide
  pidilizumab[PD-1] variable heavy Chain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 1279 - protein, 5 aa, Artificial Sequence
  Description of Artificial Sequence: Synthetic peptide
  pidilizumab[PD-1] variable heavy Chain vhCDR1
NYGMN

SEQ ID NO: 1280 - protein, 17 aa, Artificial Sequence
  Description of Artificial Sequence: Synthetic peptide
  pidilizumab[PD-1] variable heavy Chain vhCDR2
WINTDSGESTYAEEFKG

SEQ ID NO: 1281 - protein, 8 aa, Artificial Sequence
  Description of Artificial Sequence: Synthetic peptide
  pidilizumab[PD-1] variable heavy Chain vhCDR3
VGYDALDY

SEQ ID NO: 1282 - protein, 106 aa, Artificial Sequence
  Description of Artificial Sequence: Synthetic polypeptide
  pidilizumab[PD-1] variable light Chain
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 1283 - protein, 10 aa, Artificial Sequence
  Description of Artificial Sequence: Synthetic peptide
  pidilizumab[PD-1] variable light Chain vlCDR1
SARSSVSYMH

SEQ ID NO: 1284 - protein, 7 aa, Artificial Sequence
  Description of Artificial Sequence: Synthetic peptide
  pidilizumab[PD-1] variable light Chain vlCDR2
RTSNLAS

SEQ ID NO: 1285 - protein, 9 aa, Artificial Sequence
  Description of Artificial Sequence: Synthetic peptide
  pidilizumab[PD-1] variable light Chain vlCDR3
QQRSSFPLT

SEQ ID NO: 1286 - protein, 120 aa, Artificial Sequence [sequence omitted]

SEQ ID NO: 1287 - protein, 5 aa, Artificial Sequence
  Description of Artificial Sequence: Synthetic peptide
  MK-3475[PD-1] variable heavy Chain vhCDR1
NYYMY

SEQ ID NO: 1288 - protein, 17 aa, Artificial Sequence
  Description of Artificial Sequence: Synthetic peptide
  MK-3475[PD-1] variable heavy Chain vhCDR2
GINPSNGGTNFNEKFKN

SEQ ID NO: 1289 - protein, 11 aa, Artificial Sequence
  Description of Artificial Sequence: Synthetic peptide
  MK-3475[PD-1] variable heavy Chain vhCDR3
RDYRFDMGFDY

SEQ ID NO: 1290 - protein, 111 aa, Artificial Sequence [sequence omitted]

SEQ ID NO: 1291 - protein, 15 aa, Artificial Sequence
  Description of Artificial Sequence: Synthetic peptide
  MK-3475[PD-1] variable light Chain vlCDR1
RASKGVSTSGYSYLH

SEQ ID NO: 1292 - protein, 7 aa, Artificial Sequence
  Description of Artificial Sequence: Synthetic peptide
  MK-3475[PD-1] variable light Chain vlCDR2
LASYLES

SEQ ID NO: 1293 - protein, 9 aa, Artificial Sequence
  Description of Artificial Sequence: Synthetic peptide
  MK-3475[PD-1] variable light Chain vlCDR3
QHSRDLPLT

SEQ ID NO: 1294 - protein, 117 aa, Artificial Sequence
  Description of Artificial Sequence: Synthetic polypeptide
  BAP049 Clone E[PD-1] variable heavy Chain
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 1295 - protein, 5 aa, Artificial Sequence
  Description of Artificial Sequence: Synthetic peptide
  BAP049 Clone E[PD-1] variable heavy Chain vhCDR1
TYWMH

SEQ ID NO: 1296 - protein, 17 aa, Artificial Sequence
  Description of Artificial Sequence: Synthetic peptide
  BAP049 Clone E[PD-1] variable heavy Chain vhCDR2
NIYPGTGGSNFDEKFKN

SEQ ID NO: 1297 - protein, 8 aa, Artificial Sequence
  Description of Artificial Sequence: Synthetic peptide
  BAP049 Clone E[PD-1] variable heavy Chain vhCDR3
WTTGTGAY

SEQ ID NO: 1298 - protein, 113 aa, Artificial Sequence
  Description of Artificial Sequence: Synthetic polypeptide
  BAP049 Clone E[PD-1] variable light Chain
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 1299 - protein, 17 aa, Artificial Sequence
  Description of Artificial Sequence: Synthetic peptide
  BAP049 Clone E[PD-1] variable light Chain vlCDR1
KSSQSLLDSGNQKNFLT

SEQ ID NO: 1300 - protein, 7 aa, Artificial Sequence
  Description of Artificial Sequence: Synthetic peptide
  BAP049 Clone E[PD-1] variable light Chain vlCDR2
WASTRES

SEQ ID NO: 1301 - protein, 9 aa, Artificial Sequence
  Description of Artificial Sequence: Synthetic peptide
  BAP049 Clone E[PD-1] variable light Chain vlCDR3
QNDYSYPYT

SEQ ID NO: 1302 - protein, 117 aa, Artificial Sequence; identical to SEQ ID NO: 1294
  Description of Artificial Sequence: Synthetic polypeptide
  BAP049 Clone B[PD-1] variable heavy Chain

SEQ ID NO: 1303 - protein, 5 aa, Artificial Sequence
  Description of Artificial Sequence: Synthetic peptide
  BAP049 Clone B[PD-1] variable heavy Chain vhCDR1
TYWMH

SEQ ID NO: 1304 - protein, 17 aa, Artificial Sequence
  Description of Artificial Sequence: Synthetic peptide
  BAP049 Clone B[PD-1] variable heavy Chain vhCDR2
NIYPGTGGSNFDEKFKN

SEQ ID NO: 1305 - protein, 8 aa, Artificial Sequence
  Description of Artificial Sequence: Synthetic peptide
  BAP049 Clone B[PD-1] variable heavy Chain vhCDR3
WTTGTGAY

SEQ ID NO: 1306 - protein, 113 aa, Artificial Sequence
  Description of Artificial Sequence: Synthetic polypeptide
  BAP049 Clone B[PD-1] variable light Chain
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 1307 - protein, 17 aa, Artificial Sequence
  Description of Artificial Sequence: Synthetic peptide
  BAP049 Clone B[PD-1] variable light Chain vlCDR1
KSSQSLLDSGNQKNFLT

SEQ ID NO: 1308 - protein, 7 aa, Artificial Sequence
  Description of Artificial Sequence: Synthetic peptide
  BAP049 Clone B[PD-1] variable light Chain vlCDR2
WASTRES

SEQ ID NO: 1309 - protein, 9 aa, Artificial Sequence
  Description of Artificial Sequence: Synthetic peptide
  BAP049 Clone B[PD-1] variable light Chain vlCDR3
QNDYSYPYT

SEQ ID NO: 1310 - protein, 117 aa, Artificial Sequence [sequence omitted]

SEQ ID NO: 1311 - protein, 5 aa, Artificial Sequence
  Description of Artificial Sequence: Synthetic peptide
  H7798N[PD-1] variable heavy Chain vhCDR1
NFGMT

SEQ ID NO: 1312 - protein, 17 aa, Artificial Sequence
  Description of Artificial Sequence: Synthetic peptide
  H7798N[PD-1] variable heavy Chain vhCDR2
GISGGGRDTYFADSVKG

SEQ ID NO: 1313 - protein, 8 aa, Artificial Sequence
  Description of Artificial Sequence: Synthetic peptide
  H7798N[PD-1] variable heavy Chain vhCDR3
WGNIYFDY

SEQ ID NO: 1314 - protein, 107 aa, Artificial Sequence [sequence omitted]

SEQ ID NO: 1315 - protein, 11 aa, Artificial Sequence
  Description of Artificial Sequence: Synthetic peptide
  H7709N[PD-1] variable light Chain vlCDR1
RASLSINTFLN

SEQ ID NO: 1316 - protein, 7 aa, Artificial Sequence
  Description of Artificial Sequence: Synthetic peptide
  H7709N[PD-1] variable light Chain vlCDR2
AASSLHG

SEQ ID NO: 1317 - protein, 9 aa, Artificial Sequence
  Description of Artificial Sequence: Synthetic peptide
  H7709N[PD-1] variable light Chain vlCDR3
QQSSNTPFT

SEQ ID NO: 1318 - protein, 122 aa, Artificial Sequence
  Description of Artificial Sequence: Synthetic polypeptide
  h1H3 Var 6[PD-1] variable heavy Chain
EVQLVESGGGLVQPGGSLRLSCAASGFTFSDYGMHWVRQAPGKGLEWVAYISSGSYTIYYADSVKGRFTISRDNAKNTLYLQMSSLRAEDTAVYYCARRGYGSFYEYYFDYWGQGTTVTVSS

SEQ ID NO: 1319 - protein, 5 aa, Artificial Sequence
  Description of Artificial Sequence: Synthetic peptide
  h1H3 Var 6[PD-1] variable heavy Chain vhCDR1
DYGMH

SEQ ID NO: 1320 - protein, 17 aa, Artificial Sequence
  Description of Artificial Sequence: Synthetic peptide
  h1H3 Var 6[PD-1] variable heavy Chain vhCDR2
YISSGSYTIYYADSVKG

SEQ ID NO: 1321 - protein, 13 aa, Artificial Sequence
  Description of Artificial Sequence: Synthetic peptide
  h1H3 Var 6[PD-1] variable heavy Chain vhCDR3
RGYGSFYEYYFDY

SEQ ID NO: 1322 - protein, 106 aa, Artificial Sequence
  Description of Artificial Sequence: Synthetic polypeptide
  h1H3 Var 6[PD-1] variable light Chain
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 1323 - protein, 10 aa, Artificial Sequence
  Description of Artificial Sequence: Synthetic peptide
  h1H3 Var 6[PD-1] variable light Chain vlCDR1
SASSSVSYMY

SEQ ID NO: 1324 - protein, 7 aa, Artificial Sequence
  Description of Artificial Sequence: Synthetic peptide
  h1H3 Var 6[PD-1] variable light Chain vlCDR2
LTSNRAT

SEQ ID NO: 1325 - protein, 9 aa, Artificial Sequence
  Description of Artificial Sequence: Synthetic peptide
  h1H3 Var 6[PD-1] variable light Chain vlCDR3
QQWSSNPFT

SEQ ID NO: 1326 - protein, 116 aa, Artificial Sequence
  Description of Artificial Sequence: Synthetic polypeptide
  APE2058[PD-1] variable heavy Chain
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSS

SEQ ID NO: 1327 - protein, 5 aa, Artificial Sequence
  Description of Artificial Sequence: Synthetic peptide
  APE2058[PD-1] variable heavy Chain vhCDR1
SYDMS

SEQ ID NO: 1328 - protein, 17 aa, Artificial Sequence
  Description of Artificial Sequence: Synthetic peptide
  APE2058[PD-1] variable heavy Chain vhCDR2
TISGGGSYTYYQDSVKG

SEQ ID NO: 1329 - protein, 7 aa, Artificial Sequence
  Description of Artificial Sequence: Synthetic peptide
  APE2058[PD-1] variable heavy Chain vhCDR3
PYYAMDY

SEQ ID NO: 1330 - protein, 107 aa, Artificial Sequence
  Description of Artificial Sequence: Synthetic polypeptide
  APE2058[PD-1] variable light Chain
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIK

SEQ ID NO: 1331 - protein, 11 aa, Artificial Sequence
  Description of Artificial Sequence: Synthetic peptide
  APE2058[PD-1] variable light Chain vlCDR1
KASQDVGTAVA

SEQ ID NO: 1332 - protein, 7 aa, Artificial Sequence
  Description of Artificial Sequence: Synthetic peptide
  APE2058[PD-1] variable light Chain vlCDR2
WASTLHT

SEQ ID NO: 1333 - protein, 9 aa, Artificial Sequence
  Description of Artificial Sequence: Synthetic peptide
  APE2058[PD-1] variable light Chain vlCDR3
QHYSSYPWT

SEQ ID NO: 1334 - protein, 116 aa, Artificial Sequence
  Description of Artificial Sequence: Synthetic polypeptide
  H005-1[PD-1] variable heavy Chain
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSS

SEQ ID NO: 1335 - protein, 5 aa, Artificial Sequence
  Description of Artificial Sequence: Synthetic peptide
  H005-1[PD-1] variable heavy Chain vhCDR1
SYMMS

SEQ ID NO: 1336 - protein, 17 aa, Artificial Sequence
  Description of Artificial Sequence: Synthetic peptide
  H005-1[PD-1] variable heavy Chain vhCDR2
TISGGGANTYYPDSVKG

SEQ ID NO: 1337 - protein, 7 aa, Artificial Sequence
  Description of Artificial Sequence: Synthetic peptide
  H005-1[PD-1] variable heavy Chain vhCDR3
QLYYFDY

SEQ ID NO: 1338 - protein, 107 aa, Artificial Sequence
  Description of Artificial Sequence: Synthetic polypeptide
  H005-1[PD-1] variable light Chain
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIK

SEQ ID NO: 1339 - protein, 11 aa, Artificial Sequence
  Description of Artificial Sequence: Synthetic peptide
  H005-1[PD-1] variable light Chain vlCDR1
LASQTIGTWLT

SEQ ID NO: 1340 - protein, 7 aa, Artificial Sequence
  Description of Artificial Sequence: Synthetic peptide
  H005-1[PD-1] variable light Chain vlCDR2
TATSLAD

SEQ ID NO: 1341 - protein, 9 aa, Artificial Sequence
  Description of Artificial Sequence: Synthetic peptide
  H005-1[PD-1] variable light Chain vlCDR3
QQVYSIPWT

SEQ ID NO: 1342 - protein, 118 aa, Artificial Sequence
  Description of Artificial Sequence: Synthetic polypeptide
  317-4B6[PD-1] variable heavy Chain
QVQLQESGPGLVKPSETLSLTCTVSGFSLTSYGVHWIRQPPGKGLEWIGVIYADGSTNYNPSLKSRVTISKDTSKNQVSLKLSSVTAADTAVYYCARAYGNYWYIDVWGQGTTVTVSS

SEQ ID NO: 1343 - protein, 5 aa, Artificial Sequence
  Description of Artificial Sequence: Synthetic peptide
  317-4B6[PD-1] variable heavy Chain vhCDR1
SYGVH

SEQ ID NO: 1344 - protein, 16 aa, Artificial Sequence
  Description of Artificial Sequence: Synthetic peptide
  317-4B6[PD-1] variable heavy Chain vhCDR2
VIYADGSTNYNPSLKS

SEQ ID NO: 1345 - protein, 10 aa, Artificial Sequence
  Description of Artificial Sequence: Synthetic peptide
  317-4B6[PD-1] variable heavy Chain vhCDR3
AYGNYWYIDV

SEQ ID NO: 1346 - protein, 107 aa, Artificial Sequence
  Description of Artificial Sequence: Synthetic polypeptide
  317-4B6[PD-1] variable light Chain
DIVMTQSPDSLAVSLGERATINCKSSESVSNDVAWYQQKPGQPPKLLINYAFHRFTGVPDRFSGSGYGTDFTLTISSLQAEDVAVYYCHQAYSSPYTFGQGTKLEIK

SEQ ID NO: 1347 - protein, 11 aa, Artificial Sequence
  Description of Artificial Sequence: Synthetic peptide
  317-4B6[PD-1] variable light Chain vlCDR1
KSSESVSNDVA

SEQ ID NO: 1348 - protein, 7 aa, Artificial Sequence
  Description of Artificial Sequence: Synthetic peptide
  317-4B6[PD-1] variable light Chain vlCDR2
YAFHRFT

SEQ ID NO: 1349 - protein, 9 aa, Artificial Sequence
  Description of Artificial Sequence: Synthetic peptide
  317-4B6[PD-1] variable light Chain vlCDR3
HQAYSSPYT

SEQ ID NO: 1350 - protein, 114 aa, Artificial Sequence
  Description of Artificial Sequence: Synthetic polypeptide
  326-4A3[PD-1] variable heavy Chain
QVQLVQSGSELKKPGASVKVSCKASGYTFTNYGMNWVRQAPGQGLKWMGWINNNNAEPTYAQDFRGRFVFSLDTSASTAYLQISSLKTEDTAVYYCARDVMDYWGQGTLVTVSS

SEQ ID NO: 1351 - protein, 5 aa, Artificial Sequence
  Description of Artificial Sequence: Synthetic peptide
  326-4A3[PD-1] variable heavy Chain vhCDR1
NYGMN

SEQ ID NO: 1352 - protein, 17 aa, Artificial Sequence
  Description of Artificial Sequence: Synthetic peptide
  326-4A3[PD-1] variable heavy Chain vhCDR2
WINNNNAEPTYAQDFRG

SEQ ID NO: 1353 - protein, 5 aa, Artificial Sequence
  Description of Artificial Sequence: Synthetic peptide
  326-4A3[PD-1] variable heavy Chain vhCDR3
DVMDY

SEQ ID NO: 1354 - protein, 110 aa, Artificial Sequence
  Description of Artificial Sequence: Synthetic polypeptide
  326-4A3[PD-1] variable light Chain
DIVLTQSPASLAVSPGQRATITCRASESVDNYGYSFMHWYQQKPGQPPKLLIYRASNLESGVPARFSGSGSGTDFTLTINPVEAEDTANYYCQQSKEYPTFGGGTKVEIK

SEQ ID NO: 1355 - protein, 15 aa, Artificial Sequence
  Description of Artificial Sequence: Synthetic peptide
  326-4A3[PD-1] variable light Chain vlCDR1
RASESVDNYGYSFMH

SEQ ID NO: 1356 - protein, 7 aa, Artificial Sequence
  Description of Artificial Sequence: Synthetic peptide
  326-4A3[PD-1] variable light Chain vlCDR2
RASNLES

SEQ ID NO: 1357 - protein, 8 aa, Artificial Sequence
  Description of Artificial Sequence: Synthetic peptide
  326-4A3[PD-1] variable light Chain vlCDR3
QQSKEYPT

SEQ ID NO: 1358 - protein, 119 aa, Artificial Sequence
  Description of Artificial Sequence: Synthetic polypeptide
  hPD-1 mAb 7 (1.2)[PD-1] variable heavy Chain
QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSS

SEQ ID NO: 1359 - protein, 5 aa, Artificial Sequence
  Description of Artificial Sequence: Synthetic peptide
  hPD-1 mAb 7 (1.2)[PD-1] variable heavy Chain vhCDR1
SYWMN

SEQ ID NO: 1360 - protein, 17 aa, Artificial Sequence
  Description of Artificial Sequence: Synthetic peptide
  hPD-1 mAb 7 (1.2)[PD-1] variable heavy Chain vhCDR2
VIHPSDSETWLDQKFKD

SEQ ID NO: 1361 - protein, 10 aa, Artificial Sequence
  Description of Artificial Sequence: Synthetic peptide
  hPD-1 mAb 7 (1.2)[PD-1] variable heavy Chain vhCDR3
EHYGTSPFAY

SEQ ID NO: 1362 - protein, 111 aa, Artificial Sequence; identical to SEQ ID NO: 122
  Description of Artificial Sequence: Synthetic polypeptide
  hPD-1 mAb 7 (1.2)[PD-1] variable light Chain

SEQ ID NO: 1363 - protein, 15 aa, Artificial Sequence
  Description of Artificial Sequence: Synthetic peptide
  hPD-1 mAb 7 (1.2)[PD-1] variable light Chain vlCDR1
RASESVDNYGMSFMN

SEQ ID NO: 1364 - protein, 7 aa, Artificial Sequence
  Description of Artificial Sequence: Synthetic peptide
  hPD-1 mAb 7 (1.2)[PD-1] variable light Chain vlCDR2
AASNQGS

SEQ ID NO: 1365 - protein, 9 aa, Artificial Sequence
  Description of Artificial Sequence: Synthetic peptide
  hPD-1 mAb 7 (1.2)[PD-1] variable light Chain vlCDR3
QQSKEVPYT

SEQ ID NO: 1366 - protein, 125 aa, Artificial Sequence [sequence omitted]

SEQ ID NO: 1367 - protein, 5 aa, Artificial Sequence
  Description of Artificial Sequence: Synthetic peptide
  Clone 38[PD-1] variable heavy Chain vhCDR1
DYEMH

SEQ ID NO: 1368 - protein, 17 aa, Artificial Sequence
  Description of Artificial Sequence: Synthetic peptide
  Clone 38[PD-1] variable heavy Chain vhCDR2
VIESETGGTAYNQKFKG

SEQ ID NO: 1369 - protein, 16 aa, Artificial Sequence
  Description of Artificial Sequence: Synthetic peptide
  Clone 38[PD-1] variable heavy Chain vhCDR3
EGITTVATTYYWYFDV

SEQ ID NO: 1370 - protein, 112 aa, Artificial Sequence [sequence omitted]

SEQ ID NO: 1371 - protein, 16 aa, Artificial Sequence
  Description of Artificial Sequence: Synthetic peptide
  Clone 38[PD-1] variable light Chain vlCDR1
RSSQSIVHSNGNTYLE

SEQ ID NO: 1372 - protein, 7 aa, Artificial Sequence
  Description of Artificial Sequence: Synthetic peptide
  Clone 38[PD-1] variable light Chain vlCDR2
KVSNRFS

SEQ ID NO: 1373 - protein, 9 aa, Artificial Sequence
  Description of Artificial Sequence: Synthetic peptide
  Clone 38[PD-1] variable light Chain vlCDR3
FQGSHVPLT

SEQ ID NO: 1374 - protein, 125 aa, Artificial Sequence
  Description of Artificial Sequence: Synthetic polypeptide
  Clone 39[PD-1] variable heavy Chain
QGQLVQSGAEVKKPGASVKVSCKASGYTFTDYEMHWVRQAPGQGLEWMGVIESETGGTAYNQKFKGRAKITADKSTSTAYMELSSLRSEDTAVYYCTREGITTVATTYYWYFDVWGQGTTVTVSS

SEQ ID NO: 1375 - protein, 5 aa, Artificial Sequence
  Description of Artificial Sequence: Synthetic peptide
  Clone 39[PD-1] variable heavy Chain vhCDR1
DYEMH

SEQ ID NO: 1376 - protein, 17 aa, Artificial Sequence
  Description of Artificial Sequence: Synthetic peptide
  Clone 39[PD-1] variable heavy Chain vhCDR2
VIESETGGTAYNQKFKG

SEQ ID NO: 1377 - protein, 16 aa, Artificial Sequence
  Description of Artificial Sequence: Synthetic peptide
  Clone 39[PD-1] variable heavy Chain vhCDR3
EGITTVATTYYWYFDV

SEQ ID NO: 1378 - protein, 112 aa, Artificial Sequence [sequence omitted]

SEQ ID NO: 1379 - protein, 16 aa, Artificial Sequence
  Description of Artificial Sequence: Synthetic peptide
  Clone 39[PD-1] variable light Chain vlCDR1
RSSQSIVHSNGNTYLE

SEQ ID NO: 1380 - protein, 7 aa, Artificial Sequence
  Description of Artificial Sequence: Synthetic peptide
  Clone 39[PD-1] variable light Chain vlCDR2
KVSNRFS

SEQ ID NO: 1381 - protein, 9 aa, Artificial Sequence
  Description of Artificial Sequence: Synthetic peptide
  Clone 39[PD-1] variable light Chain vlCDR3
FQGSHVPLT

SEQ ID NO: 1382 - protein, 125 aa, Artificial Sequence
  Description of Artificial Sequence: Synthetic polypeptide
  Clone 41[PD-1] variable heavy Chain
QGQLVQSGAEVKKPGASVKVSCKASGYTFTDYEMHWVRQAPGQGLEWMGVIESETGGTAYNQKFQGRVTLTADKSSSTAYMELSSLRSEDTAVYYCTREGITTVATTYYWYFDVWGQGTLVTVSS

SEQ ID NO: 1383 - protein, 5 aa, Artificial Sequence
  Description of Artificial Sequence: Synthetic peptide
  Clone 41[PD-1] variable heavy Chain vhCDR1
DYEMH

SEQ ID NO: 1384 - protein, 17 aa, Artificial Sequence
  Description of Artificial Sequence: Synthetic peptide
  Clone 41[PD-1] variable heavy Chain vhCDR2
VIESETGGTAYNQKFQG

SEQ ID NO: 1385 - protein, 16 aa, Artificial Sequence
  Description of Artificial Sequence: Synthetic peptide
  Clone 41[PD-1] variable heavy Chain vhCDR3
EGITTVATTYYWYFDV

SEQ ID NO: 1386 - protein, 112 aa, Artificial Sequence [sequence omitted]

SEQ ID NO: 1387 - protein, 16 aa, Artificial Sequence
  Description of Artificial Sequence: Synthetic peptide
  Clone 41[PD-1] variable light Chain vlCDR1
RSSQSIVHSNGNTYLE

SEQ ID NO: 1388 - protein, 7 aa, Artificial Sequence
  Description of Artificial Sequence: Synthetic peptide
  Clone 41[PD-1] variable light Chain vlCDR2
KVSNRFS

SEQ ID NO: 1389 - protein, 9 aa, Artificial Sequence
  Description of Artificial Sequence: Synthetic peptide
  Clone 41[PD-1] variable light Chain vlCDR3
FQGSHVPLT

SEQ ID NO: 1390 - protein, 125 aa, Artificial Sequence; identical to SEQ ID NO: 1374
  Description of Artificial Sequence: Synthetic polypeptide
  Clone 48[PD-1] variable heavy Chain

SEQ ID NO: 1391 - protein, 5 aa, Artificial Sequence
  Description of Artificial Sequence: Synthetic peptide
  Clone 48[PD-1] variable heavy Chain vhCDR1
DYEMH

SEQ ID NO: 1392 - protein, 17 aa, Artificial Sequence
  Description of Artificial Sequence: Synthetic peptide
  Clone 48[PD-1] variable heavy Chain vhCDR2
VIESETGGTAYNQKFKG

SEQ ID NO: 1393 - protein, 16 aa, Artificial Sequence
  Description of Artificial Sequence: Synthetic peptide
  Clone 48[PD-1] variable heavy Chain vhCDR3
EGITTVATTYYWYFDV

SEQ ID NO: 1394 - protein, 112 aa, Artificial Sequence
  Description of Artificial Sequence: Synthetic polypeptide
  Clone 48[PD-1] variable light Chain
DVVMTQSPLSLPVTLGQPASISCRSSQSIVHSNGNTYLEWYLQKPGQSPRLLIYKVSNRFSGVPDRFSGSGSGTDFTLKISRVEAEDVGVYYCFQGSHVPLTFGQGTKLEIK

SEQ ID NO: 1395 - protein, 16 aa, Artificial Sequence
  Description of Artificial Sequence: Synthetic peptide
  Clone 48[PD-1] variable light Chain vlCDR1
RSSQSIVHSNGNTYLE

SEQ ID NO: 1396 - protein, 7 aa, Artificial Sequence
  Description of Artificial Sequence: Synthetic peptide
  Clone 48[PD-1] variable light Chain vlCDR2
KVSNRFS

SEQ ID NO: 1397 - protein, 9 aa, Artificial Sequence
  Description of Artificial Sequence: Synthetic peptide
  Clone 48[PD-1] variable light Chain vlCDR3
FQGSHVPLT

SEQ ID NO: 1398 - protein, 128 aa, Artificial Sequence
  Description of Artificial Sequence: Synthetic polypeptide
  PD1-17[PD-1] variable heavy Chain
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSS

SEQ ID NO: 1399 - protein, 12 aa, Artificial Sequence
  Description of Artificial Sequence: Synthetic peptide
  PD1-17[PD-1] variable heavy Chain vhCDR1
SGGSIRSTRWWS

SEQ ID NO: 1400 - protein, 16 aa, Artificial Sequence
  Description of Artificial Sequence: Synthetic peptide
  PD1-17[PD-1] variable heavy Chain vhCDR2
EIYHSGSTNYNPSLKS

SEQ ID NO: 1401 - protein, 13 aa, Artificial Sequence
  Description of Artificial Sequence: Synthetic peptide
  PD1-17[PD-1] variable heavy Chain vhCDR3
QDYGDSGDWYFDL

SEQ ID NO: 1402 - protein, 110 aa, Artificial Sequence
  Description of Artificial Sequence: Synthetic polypeptide
  PD1-17[PD-1] variable light Chain
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVL

SEQ ID NO: 1403 - protein, 13 aa, Artificial Sequence
  Description of Artificial Sequence: Synthetic peptide
  PD1-17[PD-1] variable light Chain vlCDR1
TRSSGSIASNSVQ

SEQ ID NO: 1404 - protein, 7 aa, Artificial Sequence
  Description of Artificial Sequence: Synthetic peptide
  PD1-17[PD-1] variable light Chain vlCDR2
EDNQRPS

SEQ ID NO: 1405 - protein, 9 aa, Artificial Sequence
  Description of Artificial Sequence: Synthetic peptide
  PD1-17[PD-1] variable light Chain vlCDR3
QSSDSSAVV

SEQ ID NO: 1406 - protein, 119 aa, Artificial Sequence
  Description of Artificial Sequence: Synthetic polypeptide
  PD1-28[PD-1] variable heavy Chain
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 1407 - protein, 5 aa, Artificial Sequence
  Description of Artificial Sequence: Synthetic peptide
  PD1-28[PD-1] variable heavy Chain vhCDR1
SYGIS

SEQ ID NO: 1408 - protein, 17 aa, Artificial Sequence
  Description of Artificial Sequence: Synthetic peptide
  PD1-28[PD-1] variable heavy Chain vhCDR2
WISAYNGNTNYAQKLQG

SEQ ID NO: 1409 - protein, 10 aa, Artificial Sequence
  Description of Artificial Sequence: Synthetic peptide
  PD1-28[PD-1] variable heavy Chain vhCDR3
DADYSSGSGY

SEQ ID NO: 1410 - protein, 108 aa, Artificial Sequence
  Description of Artificial Sequence: Synthetic polypeptide
  PD1-28[PD-1] variable light Chain
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 1411 - protein, 11 aa, Artificial Sequence
  Description of Artificial Sequence: Synthetic peptide
  PD1-28[PD-1] variable light Chain vlCDR1
SGDALPKQYAY

SEQ ID NO: 1412 - protein, 7 aa, Artificial Sequence
  Description of Artificial Sequence: Synthetic peptide
  PD1-28[PD-1] variable light Chain vlCDR2
KDTERPS

SEQ ID NO: 1413 - protein, 11 aa, Artificial Sequence
  Description of Artificial Sequence: Synthetic peptide
  PD1-28[PD-1] variable light Chain vlCDR3
QSADNSITYRV

SEQ ID NO: 1414 - protein, 119 aa, Artificial Sequence
  Description of Artificial Sequence: Synthetic polypeptide
  PD1-33[PD-1] variable heavy Chain
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 1415 - protein, 5 aa, Artificial Sequence
  Description of Artificial Sequence: Synthetic peptide
  PD1-33[PD-1] variable heavy Chain vhCDR1
SYYIH

SEQ ID NO: 1416 - protein, 17 aa, Artificial Sequence
  Description of Artificial Sequence: Synthetic peptide
  PD1-33[PD-1] variable heavy Chain vhCDR2
IINPRGATISYAQKFQG

SEQ ID NO: 1417 - protein, 10 aa, Artificial Sequence
  Description of Artificial Sequence: Synthetic peptide
  PD1-33[PD-1] variable heavy Chain vhCDR3
AGIYGFDFDY

SEQ ID NO: 1418 - protein, 111 aa, Artificial Sequence
  Description of Artificial Sequence: Synthetic polypeptide
  PD1-33[PD-1] variable light Chain
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 1419 - protein, 14 aa, Artificial Sequence
  Description of Artificial Sequence: Synthetic peptide
  PD1-33[PD-1] variable light Chain vlCDR1
TGTSNDVGGYNYVS

SEQ ID NO: 1420 - protein, 7 aa, Artificial Sequence
  Description of Artificial Sequence: Synthetic peptide
  PD1-33[PD-1] variable light Chain vlCDR2
DVTNRPS

SEQ ID NO: 1421 - protein, 12 aa, Artificial Sequence
  Description of Artificial Sequence: Synthetic peptide
  PD1-33[PD-1] variable light Chain vlCDR3
SSYTIVTNFEVL

SEQ ID NO: 1422 - protein, 127 aa, Artificial Sequence
  Description of Artificial Sequence: Synthetic polypeptide
  PD1-35[PD-1] variable heavy Chain
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 1423 - protein, 7 aa, Artificial Sequence
  Description of Artificial Sequence: Synthetic peptide
  PD1-35[PD-1] variable heavy Chain vhCDR1
SGAYYWS

SEQ ID NO: 1424 - protein, 16 aa, Artificial Sequence
  Description of Artificial Sequence: Synthetic peptide
  PD1-35[PD-1] variable heavy Chain vhCDR2
YIYYNGNTYYNPSLRS

SEQ ID NO: 1425 - protein, 17 aa, Artificial Sequence
  Description of Artificial Sequence: Synthetic peptide
  PD1-35[PD-1] variable heavy Chain vhCDR3
ASDYVWGGYRYMDAFDI

SEQ ID NO: 1426 - protein, 112 aa, Artificial Sequence
  Description of Artificial Sequence: Synthetic polypeptide
  PD1-35[PD-1] variable light Chain
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVLGE

SEQ ID NO: 1427 - protein, 13 aa, Artificial Sequence
  Description of Artificial Sequence: Synthetic peptide
  PD1-35[PD-1] variable light Chain vlCDR1
SGSNSNIGSNSVN

SEQ ID NO: 1428 - protein, 7 aa, Artificial Sequence
  Description of Artificial Sequence: Synthetic peptide
  PD1-35[PD-1] variable light Chain vlCDR2
GNNQRPS

SEQ ID NO: 1429 - protein, 11 aa, Artificial Sequence
  Description of Artificial Sequence: Synthetic peptide
  PD1-35[PD-1] variable light Chain vlCDR3
AAWDDSLNGPV

SEQ ID NO: 1430 - protein, 127 aa, Artificial Sequence; identical to SEQ ID NO: 107
  Description of Artificial Sequence: Synthetic polypeptide
  LOPD180[PD-1] variable heavy Chain

SEQ ID NO: 1431 - protein, 7 aa, Artificial Sequence
  Description of Artificial Sequence: Synthetic peptide
  LOPD180[PD-1] variable heavy Chain vhCDR1
SGAYYWS

SEQ ID NO: 1432 - protein, 16 aa, Artificial Sequence
  Description of Artificial Sequence: Synthetic peptide
  LOPD180[PD-1] variable heavy Chain vhCDR2
YIYYNGNTYYNPSLRS

SEQ ID NO: 1433 - protein, 17 aa, Artificial Sequence
  Description of Artificial Sequence: Synthetic peptide
  LOPD180[PD-1] variable heavy Chain vhCDR3
ASDYVWGGYHYFDAFDL

SEQ ID NO: 1434 - protein, 110 aa, Artificial Sequence; identical to SEQ ID NO: 112
  Description of Artificial Sequence: Synthetic polypeptide
  LOPD180[PD-1] variable light Chain

SEQ ID NO: 1435 - protein, 13 aa, Artificial Sequence
  Description of Artificial Sequence: Synthetic peptide
  LOPD180[PD-1] variable light Chain vlCDR1
SGSNSNIGSNSVN

SEQ ID NO: 1436 - protein, 7 aa, Artificial Sequence
  Description of Artificial Sequence: Synthetic peptide
  LOPD180[PD-1] variable light Chain vlCDR2
GNNQRPS

SEQ ID NO: 1437 - protein, 11 aa, Artificial Sequence
  Description of Artificial Sequence: Synthetic peptide
  LOPD180[PD-1] variable light Chain vlCDR3
AAWDDSLNGPV

SEQ ID NO: 1438 - protein, 119 aa, Artificial Sequence
  Description of Artificial Sequence: Synthetic polypeptide
  Ab948[PD-1] variable heavy Chain
EVQLQESGPGLVKPSQTLSLTCTVTGYSITSDYAWNWIRQPPGKKLEWMGYINYSGSTSYNPSLKSRVTISRDTSKNQFSLKLSSVTAADTAVYYCARWIGSSAWYFDVWGQGTLVTVS

SEQ ID NO: 1439 - protein, 6 aa, Artificial Sequence
  Description of Artificial Sequence: Synthetic peptide
  Ab948[PD-1] variable heavy Chain vhCDR1
SDYAWN

SEQ ID NO: 1440 - protein, 16 aa, Artificial Sequence
  Description of Artificial Sequence: Synthetic peptide
  Ab948[PD-1] variable heavy Chain vhCDR2
YINYSGSTSYNPSLKS

SEQ ID NO: 1441 - protein, 11 aa, Artificial Sequence
  Description of Artificial Sequence: Synthetic peptide
  Ab948[PD-1] variable heavy Chain vhCDR3
WIGSSAWYFDV

SEQ ID NO: 1442 - protein, 112 aa, Artificial Sequence
  Description of Artificial Sequence: Synthetic polypeptide
  Ab948[PD-1] variable light Chain
DVLMTQTPLSLSVTPGQPASISCRSGQNIVHSNGNTYLEWYLQKPGQSPKLLIYKVSNRFFGVPDRISGSGSGTDFTLKISRVEAEDVGVYFCFQGSHVPFTFGQGTKLEIK

SEQ ID NO: 1443 - protein, 16 aa, Artificial Sequence
  Description of Artificial Sequence: Synthetic peptide
  Ab948[PD-1] variable light Chain vlCDR1
RSGQNIVHSNGNTYLE

SEQ ID NO: 1444 - protein, 7 aa, Artificial Sequence
  Description of Artificial Sequence: Synthetic peptide
  Ab948[PD-1] variable light Chain vlCDR2
KVSNRFF

SEQ ID NO: 1445 - protein, 9 aa, Artificial Sequence
  Description of Artificial Sequence: Synthetic peptide
  Ab948[PD-1] variable light Chain vlCDR3
FQGSHVPFT

SEQ ID NO: 1446 - protein, 121 aa, Artificial Sequence
  Description of Artificial Sequence: Synthetic polypeptide
  humanized EH-12.2H7[PD-1] variable heavy Chain
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 1447 - protein, 5 aa, Artificial Sequence
  Description of Artificial Sequence: Synthetic peptide
  humanized EH-12.2H7[PD-1] variable heavy Chain vhCDR1
SSWIH

SEQ ID NO: 1448 - protein, 17 aa, Artificial Sequence
  Description of Artificial Sequence: Synthetic peptide
  humanized EH-12.2H7[PD-1] variable heavy Chain vhCDR2
YIYPSTGFTEYNQKFKD

SEQ ID NO: 1449 - protein, 12 aa, Artificial Sequence
  Description of Artificial Sequence: Synthetic peptide
  humanized EH-12.2H7[PD-1] variable heavy Chain vhCDR3
WRDSSGYHAMDY

SEQ ID NO: 1450 - protein, 111 aa, Artificial Sequence
  Description of Artificial Sequence: Synthetic polypeptide
  humanized EH-12.2H7[PD-1] variable light Chain
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 1451 - protein, 15 aa, Artificial Sequence
  Description of Artificial Sequence: Synthetic peptide
  humanized EH-12.2H7[PD-1] variable light Chain vlCDR1
RASQSVSTSGYSYMH

SEQ ID NO: 1452 - protein, 7 aa, Artificial Sequence
  Description of Artificial Sequence: Synthetic peptide
  humanized EH-12.2H7[PD-1] variable light Chain vlCDR2
FGSNLES

SEQ ID NO: 1453 - protein, 9 aa, Artificial Sequence
  Description of Artificial Sequence: Synthetic peptide
  humanized EH-12.2H7[PD-1] variable light Chain vlCDR3
QHSWEIPYT

SEQ ID NO: 1454 - protein, 119 aa, Artificial Sequence
  Description of Artificial Sequence: Synthetic polypeptide
  RG1H10[PD-1] variable heavy Chain
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 1455 - protein, 5 aa, Artificial Sequence
  Description of Artificial Sequence: Synthetic peptide
  RG1H10[PD-1] variable heavy Chain vhCDR1
DNGVN

SEQ ID NO: 1456 - protein, 17 aa, Artificial Sequence
  Description of Artificial Sequence: Synthetic peptide
  RG1H10[PD-1] variable heavy Chain vhCDR2
WINTKIGNPTYAQGFTG

SEQ ID NO: 1457 - protein, 10 aa, Artificial Sequence
  Description of Artificial Sequence: Synthetic peptide
  RG1H10[PD-1] variable heavy Chain vhCDR3
EHDYYYGMDV

SEQ ID NO: 1458 - protein, 111 aa, Artificial Sequence
  Description of Artificial Sequence: Synthetic polypeptide
  RG1H10[PD-1] variable light Chain
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 1459 - protein, 14 aa, Artificial Sequence
  Description of Artificial Sequence: Synthetic peptide
  RG1H10[PD-1] variable light Chain vlCDR1
TGTSSDVGGYNYVS

SEQ ID NO: 1460 - protein, 7 aa, Artificial Sequence
  Description of Artificial Sequence: Synthetic peptide
  RG1H10[PD-1] variable light Chain vlCDR2
EVSKRPS

SEQ ID NO: 1461 - protein, 11 aa, Artificial Sequence
  Description of Artificial Sequence: Synthetic peptide
  RG1H10[PD-1] variable light Chain vlCDR3
SAWDDSLNADV

SEQ ID NO: 1462 - protein, 119 aa, Artificial Sequence
  Description of Artificial Sequence: Synthetic polypeptide
  RG1H10-H2A-22-1S[PD-1] variable heavy Chain
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 1463 - protein, 5 aa, Artificial Sequence
  Description of Artificial Sequence: Synthetic peptide
  RG1H10-H2A-22-1S[PD-1] variable heavy Chain vhCDR1
DNGVN

SEQ ID NO: 1464 - protein, 17 aa, Artificial Sequence
  Description of Artificial Sequence: Synthetic peptide
  RG1H10-H2A-22-1S[PD-1] variable heavy Chain vhCDR2
WINTKDGNPTYAQGFTG

SEQ ID NO: 1465 - protein, 10 aa, Artificial Sequence
  Description of Artificial Sequence: Synthetic peptide
  RG1H10-H2A-22-1S[PD-1] variable heavy Chain vhCDR3
EHDYYYGMDV

SEQ ID NO: 1466 - protein, 111 aa, Artificial Sequence; identical to SEQ ID NO: 1458
  Description of Artificial Sequence: Synthetic polypeptide
  RG1H10-H2A-22-1S[PD-1] variable light Chain

SEQ ID NO: 1467 - protein, 14 aa, Artificial Sequence
  Description of Artificial Sequence: Synthetic peptide
  RG1H10-H2A-22-1S[PD-1] variable light Chain vlCDR1
TGTSSDVGGYNYVS

SEQ ID NO: 1468 - protein, 7 aa, Artificial Sequence
  Description of Artificial Sequence: Synthetic peptide
  RG1H10-H2A-22-1S[PD-1] variable light Chain vlCDR2
EVSKRPS

SEQ ID NO: 1469 - protein, 11 aa, Artificial Sequence
  Description of Artificial Sequence: Synthetic peptide
  RG1H10-H2A-22-1S[PD-1] variable light Chain vlCDR3
SAWDDSLNADV

SEQ ID NO: 1470 - protein, 119 aa, Artificial Sequence
  Description of Artificial Sequence: Synthetic polypeptide
  RG1H10-H2A-27-2S[PD-1] variable heavy Chain
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 1471 - protein, 5 aa, Artificial Sequence
  Description of Artificial Sequence: Synthetic peptide
  RG1H10-H2A-27-2S[PD-1] variable heavy Chain vhCDR1
DNGVN

SEQ ID NO: 1472 - protein, 17 aa, Artificial Sequence
  Description of Artificial Sequence: Synthetic peptide
  RG1H10-H2A-27-2S[PD-1] variable heavy Chain vhCDR2
WINTKTGNPTYAQGFTG

SEQ ID NO: 1473 - protein, 10 aa, Artificial Sequence
  Description of Artificial Sequence: Synthetic peptide
  RG1H10-H2A-27-2S[PD-1] variable heavy Chain vhCDR3
EHDYYYGMDV

SEQ ID NO: 1474 - protein, 111 aa, Artificial Sequence; identical to SEQ ID NO: 1458
  Description of Artificial Sequence: Synthetic polypeptide
  RG1H10-H2A-27-2S[PD-1] variable light Chain

SEQ ID NO: 1475 - protein, 14 aa, Artificial Sequence
  Description of Artificial Sequence: Synthetic peptide
  RG1H10-H2A-27-2S[PD-1] variable light Chain vlCDR1
TGTSSDVGGYNYVS

SEQ ID NO: 1476 - protein, 7 aa, Artificial Sequence
  Description of Artificial Sequence: Synthetic peptide
  RG1H10-H2A-27-2S[PD-1] variable light Chain vlCDR2
EVSKRPS

SEQ ID NO: 1477 - protein, 11 aa, Artificial Sequence
  Description of Artificial Sequence: Synthetic peptide
  RG1H10-H2A-27-2S[PD-1] variable light Chain vlCDR3
SAWDDSLNADV

SEQ ID NO: 1478 - protein, 119 aa, Artificial Sequence
  Description of Artificial Sequence: Synthetic polypeptide
  RG1H10-3C[PD-1] variable heavy Chain
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 1479 - protein, 5 aa, Artificial Sequence
  Description of Artificial Sequence: Synthetic peptide
  RG1H10-3C[PD-1] variable heavy Chain vhCDR1
DNGVN

SEQ ID NO: 1480 - protein, 17 aa, Artificial Sequence
  Description of Artificial Sequence: Synthetic peptide
  RG1H10-3C[PD-1] variable heavy Chain vhCDR2
WINTKDGNPTYAQGFTG

SEQ ID NO: 1481 - protein, 10 aa, Artificial Sequence
  Description of Artificial Sequence: Synthetic peptide
  RG1H10-3C[PD-1] variable heavy Chain vhCDR3
EHDYYYGMDV

SEQ ID NO: 1482 - protein, 111 aa, Artificial Sequence; identical to SEQ ID NO: 1458
  Description of Artificial Sequence: Synthetic polypeptide
  RG1H10-3C[PD-1] variable light Chain

SEQ ID NO: 1483 - protein, 14 aa, Artificial Sequence
  Description of Artificial Sequence: Synthetic peptide
  RG1H10-3C[PD-1] variable light Chain vlCDR1
TGTSSDVGGYNYVS

SEQ ID NO: 1484 - protein, 7 aa, Artificial Sequence
  Description of Artificial Sequence: Synthetic peptide
  RG1H10-3C[PD-1] variable light Chain vlCDR2
EVSKRPS

SEQ ID NO: 1485 - protein, 11 aa, Artificial Sequence
  Description of Artificial Sequence: Synthetic peptide
  RG1H10-3C[PD-1] variable light Chain vlCDR3
SAWDDSLNADV

SEQ ID NO: 1486 - protein, 118 aa, Artificial Sequence
  Description of Artificial Sequence: Synthetic polypeptide
  RG1H10-16C[PD-1] variable heavy Chain
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 1487 - protein, 5 aa, Artificial Sequence
  Description of Artificial Sequence: Synthetic peptide
  RG1H10-16C[PD-1] variable heavy Chain vhCDR1
DNGVN

SEQ ID NO: 1488 - protein, 17 aa, Artificial Sequence
  Description of Artificial Sequence: Synthetic peptide
  RG1H10-16C[PD-1] variable heavy Chain vhCDR2
WINTKTGNPTYAQGFTG

SEQ ID NO: 1489 - protein, 10 aa, Artificial Sequence
  Description of Artificial Sequence: Synthetic peptide
  RG1H10-16C[PD-1] variable heavy Chain vhCDR3
EHDYYYGMDV

SEQ ID NO: 1490 - protein, 111 aa, Artificial Sequence; identical to SEQ ID NO: 1458
  Description of Artificial Sequence: Synthetic polypeptide
  RG1H10-16C[PD-1] variable light Chain

SEQ ID NO: 1491 - protein, 14 aa, Artificial Sequence
  Description of Artificial Sequence: Synthetic peptide
  RG1H10-16C[PD-1] variable light Chain vlCDR1
TGTSSDVGGYNYVS

SEQ ID NO: 1492 - protein, 7 aa, Artificial Sequence
  Description of Artificial Sequence: Synthetic peptide
  RG1H10-16C[PD-1] variable light Chain vlCDR2
EVSKRPS

SEQ ID NO: 1493 - protein, 11 aa, Artificial Sequence
  Description of Artificial Sequence: Synthetic peptide
  RG1H10-16C[PD-1] variable light Chain vlCDR3
SAWDDSLNADV

SEQ ID NO: 1494 - protein, 119 aa, Artificial Sequence
  Description of Artificial Sequence: Synthetic polypeptide
  RG1H10-17C[PD-1] variable heavy Chain
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 1495 - protein, 5 aa, Artificial Sequence
  Description of Artificial Sequence: Synthetic peptide
  RG1H10-17C[PD-1] variable heavy Chain vhCDR1
DNGVN

SEQ ID NO: 1496 - protein, 17 aa, Artificial Sequence
  Description of Artificial Sequence: Synthetic peptide
  RG1H10-17C[PD-1] variable heavy Chain vhCDR2
WINTKSGNPTYAQGFTG

SEQ ID NO: 1497 - protein, 10 aa, Artificial Sequence
  Description of Artificial Sequence: Synthetic peptide
  RG1H10-17C[PD-1] variable heavy Chain vhCDR3
EHDYYYGMDV

SEQ ID NO: 1498 - protein, 111 aa, Artificial Sequence; identical to SEQ ID NO: 1458
  Description of Artificial Sequence: Synthetic polypeptide
  RG1H10-17C[PD-1] variable light Chain

SEQ ID NO: 1499 - protein, 14 aa, Artificial Sequence
  Description of Artificial Sequence: Synthetic peptide
  RG1H10-17C[PD-1] variable light Chain vlCDR1
TGTSSDVGGYNYVS

SEQ ID NO: 1500 - protein, 7 aa, Artificial Sequence
  Description of Artificial Sequence: Synthetic peptide
  RG1H10-17C[PD-1] variable light Chain vlCDR2
EVSKRPS

SEQ ID NO: 1501 - protein, 11 aa, Artificial Sequence
  Description of Artificial Sequence: Synthetic peptide
  RG1H10-17C[PD-1] variable light Chain vlCDR3
SAWDDSLNADV

SEQ ID NO: 1502 - protein, 119 aa, Artificial Sequence
  Description of Artificial Sequence: Synthetic polypeptide
  RG1H10-19C[PD-1] variable heavy Chain
QVQLVQSGSELKKPGASVKISCKASGYKFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 1503 - protein, 5 aa, Artificial Sequence
  Description of Artificial Sequence: Synthetic peptide
  RG1H10-19C[PD-1] variable heavy Chain vhCDR1
DNGVN

SEQ ID NO: 1504 - protein, 17 aa, Artificial Sequence
  Description of Artificial Sequence: Synthetic peptide
  RG1H10-19C[PD-1] variable heavy Chain vhCDR2
WINTKTGNPTYAQGFTG

SEQ ID NO: 1505 - protein, 10 aa, Artificial Sequence
  Description of Artificial Sequence: Synthetic peptide
  RG1H10-19C[PD-1] variable heavy Chain vhCDR3
EHDYYYGMDV

SEQ ID NO: 1506 - protein, 111 aa, Artificial Sequence; identical to SEQ ID NO: 1458
  Description of Artificial Sequence: Synthetic polypeptide
  RG1H10-19C[PD-1] variable light Chain

SEQ ID NO: 1507 - protein, 14 aa, Artificial Sequence
  Description of Artificial Sequence: Synthetic peptide
  RG1H10-19C[PD-1] variable light Chain vlCDR1
TGTSSDVGGYNYVS

SEQ ID NO: 1508 - protein, 7 aa, Artificial Sequence
  Description of Artificial Sequence: Synthetic peptide
  RG1H10-19C[PD-1] variable light Chain vlCDR2
EVSKRPS

SEQ ID NO: 1509 - protein, 11 aa, Artificial Sequence
  Description of Artificial Sequence: Synthetic peptide
  RG1H10-19C[PD-1] variable light Chain vlCDR3
SAWDDSLNADV

SEQ ID NO: 1510 - protein, 119 aa, Artificial Sequence
  Description of Artificial Sequence: Synthetic polypeptide
  RG1H10-21C[PD-1] variable heavy Chain
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 1511 - protein, 5 aa, Artificial Sequence
  Description of Artificial Sequence: Synthetic peptide
  RG1H10-21C[PD-1] variable heavy Chain vhCDR1
DNGVN

SEQ ID NO: 1512 - protein, 17 aa, Artificial Sequence
  Description of Artificial Sequence: Synthetic peptide
  RG1H10-21C[PD-1] variable heavy Chain vhCDR2
WINTKSGNPTYAQGFTG

SEQ ID NO: 1513 - protein, 10 aa, Artificial Sequence
  Description of Artificial Sequence: Synthetic peptide
  RG1H10-21C[PD-1] variable heavy Chain vhCDR3
EHDYYYGMDV

SEQ ID NO: 1514 - protein, 111 aa, Artificial Sequence; identical to SEQ ID NO: 1458
  Description of Artificial Sequence: Synthetic polypeptide
  RG1H10-21C[PD-1] variable light Chain

SEQ ID NO: 1515 - protein, 14 aa, Artificial Sequence
  Description of Artificial Sequence: Synthetic peptide
  RG1H10-21C[PD-1] variable light Chain vlCDR1
TGTSSDVGGYNYVS

SEQ ID NO: 1516 - protein, 7 aa, Artificial Sequence
  Description of Artificial Sequence: Synthetic peptide
  RG1H10-21C[PD-1] variable light Chain vlCDR2
EVSKRPS

SEQ ID NO: 1517 - protein, 11 aa, Artificial Sequence
  Description of Artificial Sequence: Synthetic peptide
  RG1H10-21C[PD-1] variable light Chain vlCDR3
SAWDDSLNADV

SEQ ID NO: 1518 - protein, 119 aa, Artificial Sequence
  Description of Artificial Sequence: Synthetic polypeptide
  RG1H10-23C2[PD-1] variable heavy Chain
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 1519 - protein, 5 aa, Artificial Sequence
  Description of Artificial Sequence: Synthetic peptide
  RG1H10-23C2[PD-1] variable heavy Chain vhCDR1
DNGVN

SEQ ID NO: 1520 - protein, 17 aa, Artificial Sequence
  Description of Artificial Sequence: Synthetic peptide
  RG1H10-23C2[PD-1] variable heavy Chain vhCDR2
WINTKDGNPTYAQGFTG

SEQ ID NO: 1521 - protein, 10 aa, Artificial Sequence
  Description of Artificial Sequence: Synthetic peptide
  RG1H10-23C2[PD-1] variable heavy Chain vhCDR3
EHDYYYGMDV

SEQ ID NO: 1522 - protein, 111 aa, Artificial Sequence; identical to SEQ ID NO: 1458
  Description of Artificial Sequence: Synthetic polypeptide
  RG1H10-23C2[PD-1] variable light Chain

SEQ ID NO: 1523 - protein, 14 aa, Artificial Sequence
  Description of Artificial Sequence: Synthetic peptide
  RG1H10-23C2[PD-1] variable light Chain vlCDR1
TGTSSDVGGYNYVS

SEQ ID NO: 1524 - protein, 7 aa, Artificial Sequence
  Description of Artificial Sequence: Synthetic peptide
  RG1H10-23C2[PD-1] variable light Chain vlCDR2
EVSKRPS

SEQ ID NO: 1525 - protein, 11 aa, Artificial Sequence
  Description of Artificial Sequence: Synthetic peptide
  RG1H10-23C2[PD-1] variable light Chain vlCDR3
SAWDDSLNADV

SEQ ID NO: 1526 - protein, 117 aa, Artificial Sequence
  Description of Artificial Sequence: Synthetic polypeptide
  mAb7[PD-1] variable heavy Chain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 1527 - protein, 5 aa, Artificial Sequence
  Description of Artificial Sequence: Synthetic peptide
  mAb7[PD-1] variable heavy Chain vhCDR1
SYWIN

SEQ ID NO: 1528 - protein, 17 aa, Artificial Sequence
  Description of Artificial Sequence: Synthetic peptide
  mAb7[PD-1] variable heavy Chain vhCDR2
NIYPGSSLTNYNEKFKN

SEQ ID NO: 1529 - protein, 8 aa, Artificial Sequence
  Description of Artificial Sequence: Synthetic peptide
  mAb7[PD-1] variable heavy Chain vhCDR3
LSTGTFAY

SEQ ID NO: 1530 - protein, 113 aa, Artificial Sequence
  Description of Artificial Sequence: Synthetic polypeptide
  mAb7[PD-1] variable light Chain
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 1531 - protein, 17 aa, Artificial Sequence
  Description of Artificial Sequence: Synthetic peptide
  mAb7[PD-1] variable light Chain vlCDR1
KSSQSLWDSGNQKNFLT

SEQ ID NO: 1532 - protein, 7 aa, Artificial Sequence
  Description of Artificial Sequence: Synthetic peptide
  mAb7[PD-1] variable light Chain vlCDR2
WTSYRES

SEQ ID NO: 1533 - protein, 9 aa, Artificial Sequence
  Description of Artificial Sequence: Synthetic peptide
  mAb7[PD-1] variable light Chain vlCDR3
QNDYFYPHT

SEQ ID NO: 1534 - protein, 124 aa, Artificial Sequence
  Description of Artificial Sequence: Synthetic polypeptide
  PD1AB-6[PD-1] variable heavy Chain
EVQLVQSGAEVKKPGATVKISCKASGFNIKDTYMHWVQQAPGKGLEWMGRIDPANGDRKYDPKFQGRVTITADTSTDTAYMELSSLRSEDTAVYYCARSGPVYYYGSSYVMDYWGQGTTVTVSS

SEQ ID NO: 1535 - protein, 5 aa, Artificial Sequence
  Description of Artificial Sequence: Synthetic peptide
  PD1AB-6[PD-1] variable heavy Chain vhCDR1
DTYMH

SEQ ID NO: 1536 - protein, 17 aa, Artificial Sequence
  Description of Artificial Sequence: Synthetic peptide
  PD1AB-6[PD-1] variable heavy Chain vhCDR2
RIDPANGDRKYDPKFQG

SEQ ID NO: 1537 - protein, 15 aa, Artificial Sequence
  Description of Artificial Sequence: Synthetic peptide
  PD1AB-6[PD-1] variable heavy Chain vhCDR3
SGPVYYYGSSYVMDY

SEQ ID NO: 1538 - protein, 112 aa, Artificial Sequence
  Description of Artificial Sequence: Synthetic polypeptide
  PD1AB-6[PD-1] variable light Chain
DIVMTQSPDSLAVSLGERATINCKSGQSVLYSSNQKNFLAWYQQKPGQPPKLLIYWASTRESGVPDRFSGSGSGTDFTLTISSLQAEDVAVYYCHQYLYSWTFGQGTKLEIK

SEQ ID NO: 1539 - protein, 17 aa, Artificial Sequence
  Description of Artificial Sequence: Synthetic peptide
  PD1AB-6[PD-1] variable light Chain vlCDR1
KSGQSVLYSSNQKNFLA

SEQ ID NO: 1540 - protein, 7 aa, Artificial Sequence
  Description of Artificial Sequence: Synthetic peptide
  PD1AB-6[PD-1] variable light Chain vlCDR2
WASTRES

SEQ ID NO: 1541 - protein, 8 aa, Artificial Sequence
  Description of Artificial Sequence: Synthetic peptide
  PD1AB-6[PD-1] variable light Chain vlCDR3
HQYLYSWT

SEQ ID NO: 1542 - protein, 209 aa, Artificial Sequence
  Description of Artificial Sequence: Synthetic polypeptide
  scIL-15/Ralpha(sushi)
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1543 - protein, 65 aa, Artificial Sequence; identical to SEQ ID NO: 4
  Description of Artificial Sequence: Synthetic polypeptide
  scIL-15/Ralpha(sushi)  IL-15Ralpha(sushi)

SEQ ID NO: 1544 - protein, 114 aa, Artificial Sequence; identical to SEQ ID NO: 2
  Description of Artificial Sequence: Synthetic polypeptide
  scIL-15/Ralpha(sushi)  IL-15

SEQ ID NO: 1545 - protein, 114 aa, Artificial Sequence; identical to SEQ ID NO: 274
  Description of Artificial Sequence: Synthetic polypeptide
  Chain 1 - IL-15(E87C)

SEQ ID NO: 1546 - protein, 67 aa, Artificial Sequence; identical to SEQ ID NO: 282
  Description of Artificial Sequence: Synthetic polypeptide
  IL-15/Ralpha: IL15Ralpha(Sushi-D96/C97)

What is claimed is:

1. A bispecific heterodimeric protein comprising:
    a) a fusion protein comprising a first protein domain, a second protein domain, and a first Fc domain, wherein said first protein domain is covalently attached to the N-terminus of said second protein domain using a first domain linker, wherein said second protein domain is covalently attached to the N-terminus of said first Fc domain using a second domain linker, and wherein said first protein domain comprises a human IL-15Rα(sushi) protein and said second protein domain comprises a variant of a human IL-15 protein of SEQ ID NO:2 comprising amino acid substitutions selected from the group consisting of (i) N4D/N65D, (ii) D30N/N65D, and (iii) D30N/E64Q/N65D; and
    b) an antibody fusion protein comprising a PD-1 antigen binding domain (ABD) and a second Fc domain, wherein said PD-1 antigen binding domain is covalently attached to the N-terminus of said second Fc domain, and said PD-1 antigen binding domain is a single chain variable fragment (scFv) or a Fab fragment;
    wherein said first and said second Fc domains are variants of a human IgG1 Fc domain and have a set of amino acid substitutions selected from the group consisting of (i) S267K/L368D/K370S:S267K/S364K/E357Q; (ii) S364K/E357Q:L368D/K370S; (iii) L368D/K370S:S364K; (iv) L368E/K370S:S364K; (v) T411E/K360E/Q362E: D401K; (vi) L368D/K370S:S364K/E357Q; and (vii) K370S:S364K/E357Q, according to EU numbering.

2. The bispecific heterodimeric protein according to claim 1, wherein said first and/or said second Fc domains have an additional set of amino acid substitutions comprising Q295E/N384D/Q418E/N421D, according to EU numbering.

3. The bispecific heterodimeric protein according to claim 1, wherein said first and/or said second Fc domains have an additional set of amino acid substitutions selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

4. The bispecific heterodimeric protein according to claim 1, wherein said PD-1 antigen binding domain comprises an anti-PD-1 scFv or an anti-PD-1 Fab.

5. A nucleic acid composition comprising:
   a) a first nucleic acid encoding said fusion protein of claim 1; and
   b) a second nucleic acid encoding said antibody fusion protein of claim 1.

6. An expression vector comprising:
   a) a first expression vector comprising the first nucleic acid composition of claim 5; and
   b) a second expression vector comprising the second nucleic acid composition of claim 5.

7. An expression vector composition comprising said first nucleic acid composition of claim 5 and said second nucleic acid composition of claim 5.

8. A host cell comprising the expression vector composition of claim 7.

9. A method of producing a bispecific heterodimeric protein comprising culturing the host cell of claim 8 under suitable conditions wherein said bispecific heterodimeric protein is expressed, and recovering said protein.

10. A bispecific heterodimeric protein comprising:
    a) a fusion protein comprising a first protein domain and a first Fc domain, wherein said first protein domain is covalently attached to the N-terminus of said first Fc domain using a domain linker and said first protein domain comprises a human IL-15Rα(sushi) protein;
    b) a second protein domain noncovalently attached to said first protein domain, said second protein domain comprises aft variant of a human IL-15 protein of SEQ ID NO:2 comprising amino acid substitutions selected from the group consisting of (i) N4D/N65D, (ii) D30N/N65D, and (iii) D30N/E64Q/N65D; and
    c) an antibody fusion protein comprising a PD-1 antigen binding domain and a second Fc domain, wherein said PD-1 antigen binding domain is covalently attached to the N-terminus of said second Fc domain and said PD-1 antigen binding domain is a single chain variable fragment (scFv) or a Fab fragment;
    wherein said first and said second Fc domains are variants of a human IgG1 Fc domain and have a set of amino acid substitutions selected from the group consisting of (i) S267K/L368D/K370S:S267K/S364K/E357Q; (ii) S364K/E357Q:L368D/K370S; (iii) L368D/K370S:S364K; (iv) L368E/K370S:S364K; (v) T411E/K360E/Q362E:D401K; (vi) L368D/K370S:S364K/E357Q; and (vii) K370S:S364K/E357Q, according to EU numbering.

11. The bispecific heterodimeric protein according to claim 10, wherein said variant IL-15 protein and said IL-15Rα protein have a set of amino acid substitutions selected from the group consisting of (i) E87C:D96/P97/C98; (ii) E87C:D96/C97/A98; (iii) V49C:S40C; (iv) L52C:S40C; (v) E89C:K34C; (vi) Q48C:G38C; (vii) E53C:L42C; (viii) C42S:A37C; and (ix) L45C:A37C, respectively.

12. A bispecific heterodimeric protein comprising:
    a) a first antibody fusion protein comprising a first PD-1 antigen binding domain and a first Fc domain, wherein said first PD-1 antigen binding domain is covalently attached to the N-terminus of said first Fc domain via a first domain linker, and said first PD-1 antigen binding domain is a single chain variable fragment (scFv) or a Fab fragment;
    b) a second antibody fusion protein comprising a second PD-1 antigen binding domain, a second Fc domain, and a first protein domain, wherein said second PD-1 antigen binding domain is covalently attached to the N-terminus of said second Fc domain via a second domain linker, said first protein domain is covalently attached to the C-terminus of said second Fc domain via a third domain linker, said second PD-1 antigen binding domain is a single chain variable fragment (scFv) or a Fab fragment, and said first protein domain comprises a human IL-15Rα(sushi) protein; and
    (c) a second protein domain noncovalently attached to said first protein domain of said second antibody fusion protein and comprising a variant of a human IL-15 protein of SEQ ID NO:2 comprising amino acid substitutions selected from the group consisting of (i) N4D/N65D, (ii) D30N/N65D, and (iii) D30N/E64Q/N65D,
    wherein said first and said second Fc domains are variants of a human IgG1 Fc domain and have a set of amino acid substitutions selected from the group consisting of (i) S267K/L368D/K370S:S267K/S364K/E357Q; (ii) S364K/E357Q:L368D/K370S; (iii) L368D/K370S:S364K; (iv) L368E/K370S:S364K; (v) T411E/K360E/Q362E:D401K; (vi) L368D/K370S:S364K/E357Q; and (vii) K370S:S364K/E357Q, according to EU numbering.

13. The bispecific heterodimeric protein according to claim 12, wherein said variant IL-15 protein and said IL-15Rα protein have a set of amino acid substitutions selected from the group consisting of (i) E87C:D96/P97/C98; (ii) E87C:D96/C97/A98; (iii) V49C:S40C; (iv) L52C:S40C; (v) E89C:K34C; (vi) Q48C:G38C; (vii) E53C:L42C; (viii) C42S:A37C; and (ix) L45C:A37C, respectively.

* * * * *